US011976278B2

(12) United States Patent
Hummel et al.

(10) Patent No.: US 11,976,278 B2
(45) Date of Patent: May 7, 2024

(54) RECRUITMENT METHODS AND COMPOUNDS, COMPOSITIONS AND SYSTEMS FOR RECRUITMENT

(71) Applicant: Pairwise Plants Services, Inc., Durham, NC (US)

(72) Inventors: Aaron Hummel, Hillsborough, NC (US); Shai Joshua Lawit, Durham, NC (US); Jingyi Nie, Durham, NC (US); Sabine Fräbel, Durham, NC (US); Sharon Leigh Guffy, Durham, NC (US)

(73) Assignee: Pairwise Plants Services, Inc., Durham, NC (US)

(*) Notice: Subject to any disclaimer, the term of this patent is extended or adjusted under 35 U.S.C. 154(b) by 424 days.

(21) Appl. No.: 17/113,068

(22) Filed: Dec. 6, 2020

(65) Prior Publication Data

US 2021/0171947 A1 Jun. 10, 2021

Related U.S. Application Data

(60) Provisional application No. 62/944,976, filed on Dec. 6, 2019.

(51) Int. Cl.
*C12N 15/113* (2010.01)
*C07K 14/195* (2006.01)

(52) U.S. Cl.
CPC .......... *C12N 15/113* (2013.01); *C07K 14/195* (2013.01); *C07K 2319/21* (2013.01); *C07K 2319/22* (2013.01); *C12N 2310/20* (2017.05)

(58) Field of Classification Search
None
See application file for complete search history.

(56) References Cited

U.S. PATENT DOCUMENTS

| | | | |
|---|---|---|---|
| 5,459,252 A | 10/1995 | Conkling et al. | |
| 5,604,121 A | 2/1997 | Hilder et al. | |
| 5,625,136 A | 4/1997 | Koziel et al. | |
| 5,641,876 A | 6/1997 | McElroy et al. | |
| 6,040,504 A | 3/2000 | Rice et al. | |
| 7,141,424 B2 | 11/2006 | Shin et al. | |
| 7,166,770 B2 | 1/2007 | Hohn et al. | |
| 7,579,516 B2 | 8/2009 | Boudreau | |
| 9,790,490 B2* | 10/2017 | Zhang | C12N 15/85 |
| 9,982,053 B2 | 5/2018 | Pantaleo et al. | |
| 10,421,972 B2 | 9/2019 | Lira et al. | |
| 2015/0067922 A1 | 3/2015 | Yang et al. | |
| 2015/0167000 A1 | 6/2015 | Voytas et al. | |
| 2017/0204407 A1 | 7/2017 | Gilbert et al. | |
| 2017/0219596 A1 | 8/2017 | Tanenbaum et al. | |
| 2019/0078106 A1 | 3/2019 | Anand et al. | |
| 2019/0169624 A1* | 6/2019 | Finer | C12N 15/8205 |

FOREIGN PATENT DOCUMENTS

| | | | | |
|---|---|---|---|---|
| EP | 0255378 A2 | 2/1988 | | |
| EP | 0342926 A2 | 11/1989 | | |
| EP | 0452269 A2 | 10/1991 | | |
| WO | 9307278 A1 | 4/1993 | | |
| WO | 9942587 A1 | 8/1999 | | |
| WO | 0173087 A1 | 10/2001 | | |
| WO | 2018136783 A1 | 7/2018 | | |
| WO | WO-2018140362 A1 * | 8/2018 | ............. | A61K 38/17 |

OTHER PUBLICATIONS

Tanenbaum, Marvin E., et al. "A protein-tagging system for signal amplification in gene expression and fluorescence imaging." Cell 159.3 (2014): 635-646. (Year: 2014).*
Peter J. Christie., and Gordon, Jay E. "The agrobacterium Ti plasmids." Plasmids: biology and impact in biotechnology and discovery (2015): 295-313. (Year: 2015).*
Lacroix, B., & Citovsky, V. (2019). Pathways of DNA transfer to plants from Agrobacterium tumefaciens and related bacterial species. Annual review of phytopathology, 57, 231. (Year: 2019).*
Anzalone et al. "Search-and-replace genome editing without double-strand breaks or donor DNA" Nature, 576:149-157 (2019).
Halperin et al. "CRISPR-guided DNA polymerase enable diversification of all nucleotides in a tunable window" Nature, 560:248-252 (2018).
International Search Report and the Written Opinion of the International Searching Authority corresponding to International Patent Application No. PCT/US2020/063516 (19 pages) (dated Mar. 12, 2021).
Barrangou, Rodolphe "Diversity of CRISPR-Cas immune systems and molecular machines" Genome Biology, 16(247):1-11 (2015).
Devos et al. "Expression of Agrobacterium nopaline-specific VirD1, VirD2, and VirC1 proteins and their requirement for T-strand production in *E. coli*" Molecular Plant Microbe Interactions, 2: 43 (1989).
Gelvin, S. "Traversing the Cell: Agrobacterium T-DNA's Journey to the Host Genome" Frontiers in Plant Science, 3:52 (2012).
Gilbreth et al. "Structural Insights for Engineering Binding Proteins Based on Non-Antibody Scaffolds" Current Opinion in Structural Biology, 22(4):413-420 (2012).
Grissa et al. "CRISPRFinder: a web tool to identify clustered regularly interspaced short palindromic repeats" Nucleic Acids Research, 35:W52-W57 (2007).
Hansen et al. "Agrolistic" transformation of plant cells: integration of T-strands generated in planta Proc Natl Acad Sci USA, 93(25):14978-14983 (1996).
Hansen et al. "T-strand integration in maize protoplasts after codelivery of a T-DNA substrate and virulence genes" Proc Natl Acad Sci USA, 94(21): 11726-11730 (1997).

(Continued)

*Primary Examiner* — Allison M Fox
*Assistant Examiner* — Alyssa G Weston
(74) *Attorney, Agent, or Firm* — Myers Bigel, P.A.

(57) ABSTRACT

Described herein are recruitment methods and compounds, compositions, and systems for recruitment. Also described herein are methods and compositions for template editing of genomic DNA using *Agrobacterium*-derived T-DNA molecules and/or proteins.

26 Claims, 6 Drawing Sheets

Specification includes a Sequence Listing.

(56) References Cited

OTHER PUBLICATIONS

Hou et al. "Efficient genome engineering in human pluripotent stem cells using Cas9 from Neisseria meningitidis" Proceedings of the National Academy of Sciences, 110(39): 15644-15649 (2013).
Jiang et al. "CRISPR-assisted editing of bacterial genomes" Nature Biotechnology, 31(3):233-239 (2013).
Mali et al. "Cas9 as a versatile tool for engineering biology" Nature Methods, 10(10):957-963 (2013).
Mali et al. "RNA-Guided Human Genome Engineering via Cas9" Science, 339(6121):823-826 (2013).
Pelczar et al. "Agrobacterium proteins VirD2 and VirE2 mediate precise integration of synthetic T-DNA complexes in mammalian cells" EMBO Rep, 5(6):632-637 (2004).
Ran et al. "Genome engineering using the CRISPR-Cas9 system" Nature Protocols, 8(11):2281-2308 (2013).
Sha et al. "Monobodies and other synthetic binding proteins for expanding protein science" Protein Science, 26:910-924 (2017).
Singer, K. "The Mechanism of T-DNA Integration: Some Major Unresolved Questions. Current Topics in Microbiology and Immunology" Springer International Publishing AG. 418:287-317 (2018).
Tak et al. "Inducible and multiplex gene regulation using CRISPR-Cpf1-based transcription factors" Nature Methods, 14(12):1163-1166 (2017).
Tanenbaum et al. "A protein tagging system for signal amplification in gene expression and fluorescence imaging" Cell 159, 635-646 (2014).
Vob et al. "Chemically induced dimerization: reversible and spatiotemporal control of protein function in cells" Current Opinion in Chemical Biology, 28:194-201 (2015).
Wolterink-Van Loo, S. "Interaction of Agrobacterium tumefaciens virulence protein VirD2 with histones" Microbiology, 161: 401 (2015).
Ziemienowicz et al. "Import of DNA into mammalian nuclei by proteins originating from a plant pathogenic bacterium" Proc Natl Acad Sci USA, 96(7):3729-3733 (1999).

* cited by examiner

Fig. 1

RECRUITMENT METHODS AND COMPOUNDS, COMPOSITIONS AND SYSTEMS FOR RECRUITMENT

STATEMENT REGARDING ELECTRONIC FILING OF A SEQUENCE LISTING

A Sequence Listing in ASCII text format, submitted under 37 C.F.R. § 1.821, entitled 1499-13 ST25.txt, 1,752,692 bytes in size, generated on Dec. 6, 2020 and filed via EFS-Web, is provided in lieu of a paper copy. This Sequence Listing is hereby incorporated herein by reference into the specification for its disclosures.

FIELD

The invention relates to recruitment methods and to compounds, compositions, and systems for recruitment. The invention also relates to methods and compositions for template editing of genomic DNA such as using Agrobacterium-derived T-DNA molecules and/or proteins.

BACKGROUND

Precise templated editing is difficult to perform in most eukaryotic cell types due to extremely low efficiency of recovery of cells with the desired editing outcome. The low efficiency is caused by several steps in a complex process. For example, after a double strand break (DSB) is made in a eukaryotic genome, the DSB can be repaired by templated editing only when there is a template that is in the local vicinity of the DSB and that template must be immediately available during the brief period of time when the repair complex is competent to perform homology-directed repair.

The best templated editing efficiencies in eukaryotes other than yeast have been accomplished in human cell culture where the delivery of a cocktail of reagents, for example, a DNA endonuclease or nickase, a repair template, non-homologous end-joining (NHEJ) inhibitors, homology directed repair (HDR) stimulators, can be coordinated with high efficiency. It is known that single-stranded DNA, especially long ssDNA, is the most efficient template for homologous recombination in eukaryotic cells. Thus, in contrast to double-stranded DNA, in human cells, single-stranded DNA can be an efficient repair template for long or short edits. However, in plants, ssDNA is difficult to deliver efficiently, and editing is currently limited primarily to using short ssDNA oligonucleotides as repair templates that are delivered into plant cells by particle bombardment.

To date, the majority of templated editing successes in plants have been achieved using particle bombardment of DNA expression cassettes and repair templates. The editing efficiencies reported are generally less than 10%, with many studies reporting a less than 1% efficiency. Further, particle bombardment and oligonucleotide repair templates allow only small changes to be made (typically less than 40 bases). Currently, there is no reliable capability for generating large edits in plants, or for introducing whole gene cassettes or gene stacks, such as in site-directed integration. The tools that are available and the level of efficiency of editing that they provide in plants are inadequate to support robust trait discovery pipelines in crops.

The present invention overcomes previous shortcomings in the art by providing new gene editing tools for use in plants.

SUMMARY OF THE INVENTION

A first aspect of the present invention is directed to a fusion protein comprising a bacterial transfer protein and a recruiting motif (e.g., an affinity polypeptide, an RNA recruiting motif, or a peptide tag). In some embodiments, a composition, system, kit, and/or complex of the present invention includes a fusion protein comprising a bacterial transfer protein and a recruiting motif (e.g., an affinity polypeptide, an RNA recruiting motif, or a peptide tag).

Another aspect of the present invention is directed to a fusion protein comprising a bacterial transfer protein and a nucleic acid binding polypeptide. In some embodiments, a composition, system, kit, and/or complex of the present invention includes a fusion protein comprising a bacterial transfer protein and a nucleic acid binding polypeptide.

A further aspect of the present invention is directed to a fusion protein comprising an *Agrobacterium* effector protein and a recruiting motif (e.g., an affinity polypeptide, an RNA recruiting motif, or a peptide tag). In some embodiments, a composition, system, kit, and/or complex of the present invention includes a fusion protein comprising an *Agrobacterium* effector protein and a recruiting motif (e.g., an affinity polypeptide, an RNA recruiting motif, or a peptide tag).

An additional aspect of the present invention is directed to a fusion protein comprising an *Agrobacterium* effector protein and a nucleic acid binding polypeptide. In some embodiments, a composition, system, kit, and/or complex of the present invention includes a fusion protein comprising an *Agrobacterium* effector protein and a nucleic acid binding polypeptide.

A further aspect of the present invention is directed to a fusion protein comprising a nucleic acid binding polypeptide and a recruiting motif (e.g., an affinity polypeptide, an RNA recruiting motif, or a peptide tag). In some embodiments, a composition, system, kit, and/or complex of the present invention includes a fusion protein comprising a nucleic acid binding polypeptide and a recruiting motif (e.g., an affinity polypeptide, an RNA recruiting motif, or a peptide tag).

Another aspect of the present invention is directed to a method of modifying a target nucleic acid, the method comprising: contacting a target nucleic acid with a nucleic acid binding polypeptide, a guide nucleic acid, and a fusion protein comprising a bacterial transfer protein and a recruiting motif (e.g., an affinity polypeptide, an RNA recruiting motif, or a peptide tag), optionally wherein the nucleic acid binding polypeptide and the guide nucleic acid form a complex or are comprised in a complex, thereby modifying the target nucleic acid. In some embodiments, the bacterial transfer protein is an *Agrobacterium* effector protein.

A further aspect of the present invention is directed to a method of modifying a target nucleic acid, the method comprising: contacting a target nucleic acid with a guide nucleic acid and a fusion protein comprising a bacterial transfer protein and a nucleic acid binding polypeptide, optionally wherein the fusion protein and the guide nucleic acid form a complex or are comprised in a complex, thereby modifying the target nucleic acid. In some embodiments, the bacterial transfer protein is an *Agrobacterium* effector protein.

An additional aspect of the present invention is directed to a method of modifying a target nucleic acid, the method comprising: contacting a target nucleic acid with an bacterial transfer protein, a guide nucleic acid, and a fusion protein comprising a nucleic acid binding polypeptide and a recruiting motif, optionally wherein the fusion protein and the guide nucleic acid form a complex or are comprised in a complex, thereby modifying the target nucleic acid. In some embodiments, the bacterial transfer protein is an *Agrobacterium* effector protein.

Another aspect of the invention provides a composition comprising a domain fused to a recruiting motif (e.g., an affinity polypeptide or a peptide tag), wherein the domain is capable of interacting with a T-DNA sequence.

A further aspect of the invention provides a composition comprising a nucleic acid binding polypeptide fused to an affinity polypeptide, wherein the affinity polypeptide is capable of binding a domain that is capable of interacting with a T-DNA sequence, optionally wherein the affinity polypeptide is an antibody capable of binding an *Agrobacterium* effector protein.

An additional aspect of the invention provides a composition comprising (a) a domain that is capable of interacting with a T-DNA sequence (e.g., an *Agrobacterium* effector protein) fused to: (i) a nucleic acid binding polypeptide; and/or (ii) a domain that is capable of interacting with a nucleic acid binding polypeptide (e.g., an affinity polypeptide (e.g., a polypeptide capable of binding a peptide tag)).

A further aspect of the invention provides a composition comprising a nucleic acid binding polypeptide fused to an affinity polypeptide, wherein the affinity polypeptide is capable of binding a domain that is capable of interacting with a T-DNA sequence, optionally wherein the affinity polypeptide is an antibody capable of binding an *Agrobacterium* effector protein.

Another aspect of the invention provides a system comprising: (a) an *Agrobacterium* effector fusion protein comprising an *Agrobacterium* effector protein fused to a peptide tag; (b) a CRISPR-Cas effector fusion protein comprising a CRISPR-Cas effector protein fused to an affinity polypeptide that is capable of interacting with the peptide tag; (c) optionally a T-DNA; and (d) a CRISPR guide nucleic acid comprising a spacer sequence and a repeat sequence, wherein the guide nucleic acid is capable of forming a complex with the CRISPR-Cas effector protein of the CRISPR-Cas fusion protein and the spacer sequence is capable of hybridizing to a target nucleic acid, thereby guiding the CRISPR-Cas fusion protein to the target nucleic acid, wherein the affinity polypeptide of the CRISPR-Cas fusion protein interacts with the peptide tag of the *Agrobacterium* effector fusion protein and optionally the *Agrobacterium* effector protein associates with the T-DNA, if present, thereby recruiting the *Agrobacterium* effector protein and optionally the T-DNA to the CRISPR-Cas effector protein and to the target nucleic acid, whereby the system is capable of modifying the target nucleic acid.

A further aspect of the invention provides a system comprising: (a) a CRISPR-Cas effector fusion protein comprising a CRISPR-Cas effector protein fused to a peptide tag; (b) an *Agrobacterium* effector fusion protein comprising an *Agrobacterium* effector protein fused to an affinity polypeptide that is capable of interacting with the peptide tag; (c) optionally T-DNA sequence; and (d) a CRISPR guide nucleic acid comprising a spacer sequence and a repeat sequence, wherein the guide nucleic acid is capable of forming a complex with the CRISPR-Cas effector protein of the CRISPR-Cas fusion protein and the spacer sequence is capable of hybridizing to a target nucleic acid, thereby guiding the CRISPR-Cas fusion protein to the target nucleic acid, wherein the peptide tag of the CRISPR-Cas fusion protein interacts with the affinity polypeptide of the *Agrobacterium* effector fusion protein and optionally the *Agrobacterium* effector protein associates with (covalently links to, e.g., VirD2; non-covalently with, e.g., VirE2) the T-DNA sequence, if present, thereby recruiting the *Agrobacterium* effector protein and optionally the T-DNA sequence to the CRISPR-Cas effector protein and to the target nucleic acid, whereby the system is capable of modifying the target nucleic acid.

Another aspect of the invention provides a system comprising: (a) an *Agrobacterium* effector protein; (b) a CRISPR-Cas effector fusion protein comprising a CRISPR-Cas effector protein fused to an affinity polypeptide that is capable of interacting with the *Agrobacterium* effector protein (e.g., an antibody to the *Agrobacterium* effector protein); (c) optionally a T-DNA sequence; and (d) a CRISPR guide nucleic acid comprising a spacer sequence and a repeat sequence, wherein the guide nucleic acid is capable of forming a complex with the CRISPR-Cas effector protein of the CRISPR-Cas fusion protein and the spacer sequence is capable of hybridizing to a target nucleic acid, thereby guiding the CRISPR-Cas fusion protein to the target nucleic acid, wherein the affinity polypeptide of the CRISPR-Cas fusion protein interacts with the *Agrobacterium* effector protein and optionally the *Agrobacterium* effector protein associates with the T-DNA, if present, thereby recruiting the *Agrobacterium* effector protein and optionally the T-DNA to the CRISPR-Cas effector protein and to the target nucleic acid, whereby the system is capable of modifying the target nucleic acid.

A further aspect of the invention provides a method of modifying a target nucleic acid in a plant, comprising contacting the target nucleic acid with any of the fusion proteins, compositions, complexes, and/or the systems of the invention.

Another aspect of the invention provides a method of modifying a target nucleic acid, the method comprising: contacting a target nucleic acid with (a) a domain that is capable of interacting with a T-DNA sequence (e.g., an *Agrobacterium* effector protein), (b) (i) a nucleic acid binding polypeptide or (ii) a domain that is capable of interacting with the nucleic acid binding polypeptide, and (c) a T-DNA sequence.

A further aspect of the invention provides a method of modifying a target nucleic acid, the method comprising: (a)(i) a first CRISPR-Cas effector protein; and (ii) a first T-DNA sequence; and (b)(i) a second CRISPR-Cas effector protein, (ii) a DNA-dependent DNA polymerase; and (ii) a first guide nucleic acid, thereby modifying the target nucleic acid.

An additional aspect of the invention provides a system comprising: (a) an *Agrobacterium* effector fusion protein comprising an *Agrobacterium* effector protein fused to a peptide tag, (b) a CRISPR-Cas effector fusion protein comprising a CRISPR-Cas effector protein fused to an affinity polypeptide that is capable of interacting with the peptide tag; (c) optionally a T-DNA and (d) a CRISPR guide nucleic acid comprising a spacer sequence and a repeat sequence, wherein the guide nucleic acid is capable of forming a complex with the CRISPR-Cas effector protein of the CRISPR-Cas fusion protein and the spacer sequence is capable of hybridizing to a target nucleic acid, thereby guiding the CRISPR-Cas fusion protein to the target nucleic acid, wherein the affinity polypeptide of the CRISPR-Cas fusion protein interacts with the peptide tag of the *Agrobacterium* effector fusion protein and optionally the *Agrobacterium* effector protein associates with the T-DNA, if present, thereby recruiting the *Agrobacterium* effector protein and optionally the T-DNA to the CRISPR-Cas effector protein and to the target nucleic acid, whereby the system is capable of modifying the target nucleic acid.

An further aspect of the invention provides a system comprising: (a) a CRISPR-Cas effector fusion protein comprising a CRISPR-Cas effector protein fused to a peptide tag; (b) an *Agrobacterium* effector fusion protein comprising an *Agrobacterium* effector protein fused to an affinity polypeptide that is capable of interacting with the peptide tag; (c) optionally a T-DNA and (d) a CRISPR guide nucleic acid comprising a spacer sequence and a repeat sequence, wherein the guide nucleic acid is capable of forming a complex with the CRISPR-Cas effector protein of the CRISPR-Cas fusion protein and the spacer sequence is capable of hybridizing to a target nucleic acid, thereby guiding the CRISPR-Cas fusion protein to the target nucleic acid, wherein the peptide tag of the CRISPR-Cas fusion protein interacts with the affinity polypeptide of the *Agrobacterium* effector fusion protein and the *Agrobacterium* effector protein associates with (covalently links to, e.g., VirD2; non-covalently with, e.g., VirE2) the T-DNA, thereby recruiting the *Agrobacterium* effector protein and optionally the T-DNA to the CRISPR-Cas effector protein and to the target nucleic acid, whereby the system is capable of modifying the target nucleic acid.

Another aspect of the invention provides a system comprising: (a) an *Agrobacterium* effector protein; (b) a CRISPR-Cas effector fusion protein comprising a CRISPR-Cas effector protein fused to an affinity polypeptide that is capable of interacting with the *Agrobacterium* effector protein (e.g., an antibody to the *Agrobacterium* effector protein); (c) optionally a T-DNA and (d) a CRISPR guide nucleic acid comprising a spacer sequence and a repeat sequence, wherein the guide nucleic acid is capable of forming a complex with the CRISPR-Cas effector protein of the CRISPR-Cas fusion protein and the spacer sequence is capable of hybridizing to a target nucleic acid, thereby guiding the CRISPR-Cas fusion protein to the target nucleic acid, wherein the affinity polypeptide of the CRISPR-Cas fusion protein interacts with the *Agrobacterium* effector protein and optionally the *Agrobacterium* effector protein associates with (covalently links to, e.g., VirD2; non-covalently with, e.g., VirE2)) the T-DNA, if present, thereby recruiting the *Agrobacterium* effector protein and optionally the T-DNA to the CRISPR-Cas effector protein and to the target nucleic acid, whereby the system is capable of modifying the target nucleic acid.

Another aspect of the invention provides a method of modifying a target nucleic acid, comprising contacting a target nucleic acid with (a) a domain that is capable of interacting with a T-DNA sequence (e.g., an *Agrobacterium* effector protein), (b) (i) a nucleic acid binding polypeptide or (ii) a domain that is capable of interacting with the nucleic acid binding polypeptide, and (c) a T-DNA sequence.

An additional aspect of the invention provides a method of modifying a target nucleic acid, the method comprising: contacting the target nucleic acid with a composition of the invention capable of interacting with (binding) the target nucleic acid in a sequence specific manner; and recruiting to the target nucleic acid at least one T-DNA sequence comprising a nucleic acid sequence to be edited into the target nucleic acid.

A further aspect of the invention provides a method of modifying a target nucleic acid, the method comprising: (a) a nucleic acid binding polypeptide; (b) a DNA-dependent DNA polymerase; (c) a T-DNA including a primer binding site with complementarity to the sequence of a nicked target DNA strand, and, optionally, (d) a guide nucleic acid (e.g., Type V CRISPR RNA, Type V CRISPR DNA, Type V crRNA, Type V crDNA).

Another aspect of the invention provides a method of modifying a target nucleic acid, the method comprising:

(a)(i) a first CRISPR-Cas effector protein; and (ii) a first T-DNA sequence; and (b)(i) a second CRISPR-Cas effector protein, (ii) a DNA-dependent DNA polymerase; and (ii) a first guide nucleic acid, thereby modifying the target nucleic acid.

A further aspect of the invention provides an engineered *Agrobacterium* strain comprising a bacterial transfer protein (e.g., an *Agrobacterium* effector protein) fused to a recruiting motif (e.g., an affinity polypeptide or a peptide tag).

The invention further provides expression cassettes and/or vectors comprising nucleic acids of the invention and nucleic acids encoding the proteins of the invention. In addition, the invention provides cells comprising the compositions, polypeptides, fusion proteins, nucleic acids, expression cassettes and/or vectors of the invention. Additionally, the invention provides kits comprising the compositions, polypeptides, fusion proteins, nucleic acids, expression cassettes, and/or vectors of the invention and/or cells comprising the same.

These and other aspects of the invention are set forth in more detail in the description of the invention below.

BRIEF DESCRIPTION OF THE DRAWINGS

FIG. 1 shows fluorescent microscopy images of *N. benthamiana* leaves at 10-11 days after infiltration according to some embodiments of the present invention. All images were taken with the same instrument settings.

DETAILED DESCRIPTION

Figure 2:
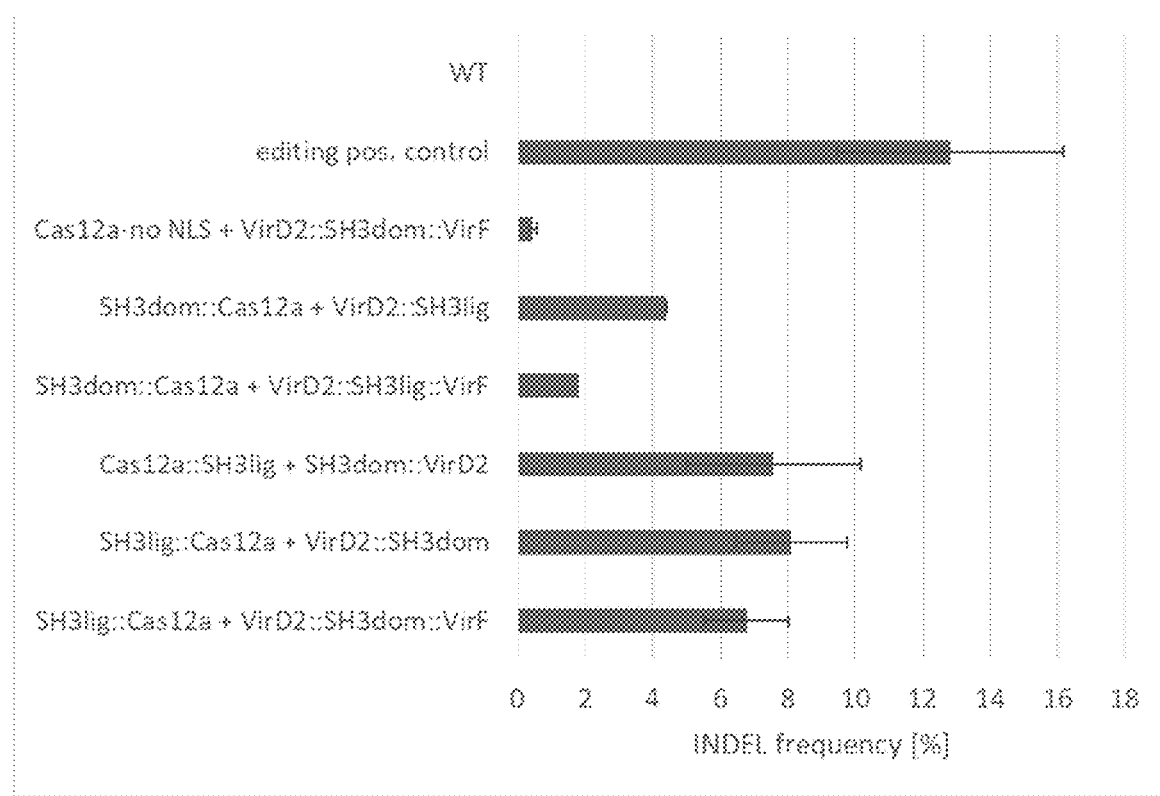
FIG. 2 is a graph showing INDEL frequency of recruited Cas12a (with no nuclear localization signal) in infiltrated *N. benthamiana* leaves at 10-11 days after infiltration according to some embodiments of the present invention.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, ±1%, ±0.5%, or even ±0.1% of the specified value as well as the specified value. For example, "about X" where X is the measurable value, is meant to include X as well as variations of ±10%, ±5%, ±1%, ±0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

Recitation of ranges of values herein are merely intended to serve as a shorthand method of referring individually to each separate value falling within the range, unless otherwise indicated herein, and each separate value is incorporated into the specification as if it were individually recited herein. For example, if the range 10 to 15 is disclosed, then 11, 12, 13, and 14 are also disclosed.

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "enhance," "enhancing," "improve" and "improving" (and grammatical variations thereof) describe an elevation of at least about 5%, 10%, 15%, 20%, 25%, 30%, 35%, 40%, 45%, 50%, 55%, 60%, 65%, 70%, 75%, 80%, 85%, 90%, 95%, 100%, 150%, 200%, 300%, 400%, 500% or more such as compared to another measurable property or quantity (e.g., a control value).

As used herein, the terms "reduce," "reduced," "reducing," "reduction," "diminish," and "decrease" (and grammatical variations thereof), describe, for example, a decrease of at least about 5%, 10%, 15%, 20%, 25%, 30%, 35%, 40%, 45%, 50%, 55%, 60%, 65%, 70%, 75%, 80%, 85%, 90%, 95%, 97%, 98%, 99%, or 100% such as compared to another measurable property or quantity (e.g., a control value). In some embodiments, the reduction can result in no or essentially no (i.e., an insignificant amount, e.g., less than about 10% or even 5%) detectable activity or amount.

A "heterologous" or a "recombinant" nucleotide sequence is a nucleotide sequence not naturally associated with a host cell into which it is introduced, including non-naturally occurring multiple copies of a naturally occurring nucleotide sequence.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the reference organism. A "homologous" nucleic acid sequence is a nucleotide sequence naturally associated with a host cell into which it is introduced.

As used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "nucleic acid construct," "recombinant nucleic acid," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end of the polynucleotide. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end of the polynucleotide. Thus, for example, an element in the 3' region of a polynucleotide can be located anywhere from the first nucleotide located at the 3' end of the polynucleotide to the nucleotide located halfway through the polynucleotide.

As used herein, the term "gene" refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue.

The terms "complementary" or "complementarity," as used herein, refer to the natural binding of polynucleotides under permissive salt and temperature conditions by base-pairing. For example, the sequence "A-G-T" (5' to 3') binds to the complementary sequence "T-C-A" (3' to 5'). Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement" as used herein can mean 100% complementarity with the comparator nucleotide sequence or it can mean less than 100% complementarity (e.g., "substantially complementary" such as about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

A "portion" or "fragment" of a nucleotide sequence polypeptide sequence will be understood to mean a nucleotide or polypeptide sequence of reduced length (e.g., reduced by 1, 2, 3, 4, 5, 6, 7, 8, 9, 10, 11, 12, 13, 14, 15, 16, 17, 18, 19, 20 or more residue(s) (e.g., nucleotide(s) or peptide(s)) relative to a reference nucleotide or polypeptide sequence, respectively, and comprising, consisting essentially of and/or consisting of a nucleotide or polypeptide sequence of contiguous residues, respectively, identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleotide or polypeptide sequence. Such a nucleic acid fragment or portion according to the invention may be, where appropriate, included in a larger polynucleotide of which it is a constituent. As an example, a repeat sequence of guide nucleic acid of this invention may comprise a portion of a wild type CRISPR-Cas repeat sequence (e.g., a wild type CRISR-Cas repeat; e.g., a repeat from the CRISPR Cas system that includes, but is not limited to, a Cas9, Cas12a (Cpf1), Cas12b, Cas12c (C2c3), Cas12d (CasY), Cas12e (CasX), Cas12g, Cas12h, Cas12i, C2c1, C2c4, C2c5, C2c8, C2c9, C2c10, Cas14a, Cas14b, and/or a Cas14c, and the like).

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (i.e., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to said nucleotide sequence of the invention.

As used herein "sequence identity" refers to the extent to which two optimally aligned polynucleotide or polypeptide sequences are invariant throughout a window of alignment of components, e.g., nucleotides or amino acids. "Identity" can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence as compared to a reference polypeptide.

As used herein, the phrase "substantially identical," or "substantial identity" in the context of two nucleic acid molecules, nucleotide sequences or protein sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 20 nucleotides, about 10 nucleotides to about 25 nucleotides, about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, or more nucleotides in length, and any range therein, up to the full length of the sequence. In some embodiments, the nucleotide sequences can be substantially identical over at least about 20 nucleotides (e.g., about 20, 21, 22, 23, 24, 25, 26, 27, 28, 29, 30, 31, 32, 33, 34, 35, 36, 37, 38, 39, 40 nucleotides). In some embodiments, a substantially identical nucleotide or protein sequence performs substantially the same function as the nucleotide (or encoded protein sequence) to which it is substantially identical.

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, CA). An "identity fraction" for aligned segments of a test sequence and a reference sequence is the number of identical components which are shared by the two aligned sequences divided by the total number of components in the reference sequence segment, e.g., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Two nucleotide sequences may also be considered substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent, and are different under different environmental parameters. An extensive guide to the hybridization of nucleic acids is found in Tijssen *Laboratory Techniques in Biochemistry and Molecular Biology-Hybridization with Nucleic Acid Probes part I* chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

A polynucleotide and/or recombinant nucleic acid construct of this invention can be codon optimized for expression. In some embodiments, a polynucleotide, nucleic acid construct, expression cassette, and/or vector of the invention (e.g., that comprises/encodes a nucleic acid binding polypeptide (e.g., a DNA binding domain such as a nucleic acid binding polypeptide from a polynucleotide-guided endonuclease, a zinc finger nuclease, a transcription activator-like effector nucleases (TALEN), an endonuclease (e.g. Fok1), an Argonaute protein, and/or a CRISPR-Cas effector protein (e.g., a Type I CRISPR-Cas effector protein, a Type II CRISPR-Cas effector protein, a Type III CRISPR-Cas effector protein, a Type IV CRISPR-Cas effector protein, a Type V CRISPR-Cas effector protein or a Type VI CRISPR-Cas effector protein))), a domain is capable of interacting with a T-DNA sequence (e.g., *Agrobacterium* effector proteins;

e.g., VirD2 and/or VirE2), a T-DNA sequence, affinity polypeptides, peptide tags, RNA recruiting motifs, fusion proteins, a DNA-dependent DNA polymerase and the like) are codon optimized for expression in an organism (e.g., an animal, a plant, a fungus, an archaeon, or a bacterium). In some embodiments, the codon optimized nucleic acid constructs, polynucleotides, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%. 99.9% or 100%) identity or more to the reference nucleic acid constructs, polynucleotides, expression cassettes, and/or vectors that have not been codon optimized.

In any of the embodiments described herein, a polynucleotide or nucleic acid construct of the invention may be operatively associated with a variety of promoters and/or other regulatory elements for expression in an organism or cell thereof (e.g., a plant and/or a cell of a plant). Thus, in some embodiments, a polynucleotide or nucleic acid construct of this invention may further comprise one or more promoters, introns, enhancers, and/or terminators operably linked to one or more nucleotide sequences. In some embodiments, a promoter may be operably associated with an intron (e.g., Ubi1 promoter and intron). In some embodiments, a promoter associated with an intron maybe referred to as a "promoter region" (e.g., Ubi1 promoter and intron).

By "operably linked" or "operably associated" as used herein in reference to polynucleotides, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, nucleic acid sequences can be present between a promoter and the nucleotide sequence, and the promoter can still be considered "operably linked" to the nucleotide sequence.

As used herein, the term "linked" or "fused" in reference to polypeptides, refers to the attachment of one polypeptide to another. A polypeptide may be linked or fused to another polypeptide (at the N-terminus or the C-terminus) directly (e.g., via a peptide bond) or through a linker (e.g., a peptide linker).

The term "linker" in reference to polypeptides is art-recognized and refers to a chemical group, or a molecule linking two molecules or moieties, e.g., two domains of a fusion protein, such as, for example, a DNA binding polypeptide or domain (e.g., a CRISPR-Cas effector protein) and a peptide tag and/or an *Agrobacterium* effector protein and an affinity polypeptide that binds to the peptide tag. A linker may be comprised of a single linking molecule (e.g., a single amino acid) or may comprise more than one linking molecule. In some embodiments, the linker can be an organic molecule, group, polymer, or chemical moiety such as a bivalent organic moiety. In some embodiments, the linker may be an amino acid or it may be a peptide. In some embodiments, the linker is a peptide.

In some embodiments, a peptide linker useful with this invention may be about 2 to about 100 or more amino acids in length, for example, about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 2 to about 40, about 2 to about 50, about 2 to about 60, about 4 to about 40, about 4 to about 50, about 4 to about 60, about 5 to about 40, about 5 to about 50, about 5 to about 60, about 9 to about 40, about 9 to about 50, about 9 to about 60, about 10 to about 40, about 10 to about 50, about 10 to about 60, or about 2, 3, 4, 5, 6, 7, 8, 9, 10, 11, 12, 13, 14, 15, 16, 17, 18, 19, 20, 21, 22, 23, 24, 25 amino acids to about 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 105, 110, 115, 120, 130, 140 150 or more amino acids in length). In some embodiments, a peptide linker may be a GS linker.

As used herein, the term "linked," or "fused" in reference to polynucleotides, refers to the attachment of one polynucleotide to another. In some embodiments, two or more polynucleotide molecules may be linked by a linker that can be an organic molecule, group, polymer, or chemical moiety such as a bivalent organic moiety. A polynucleotide may be linked or fused to another polynucleotide (at the 5' end or the 3' end) via a covalent or non-covenant linkage or binding, including e.g., Watson-Crick base-pairing, or through one or more linking nucleotides. In some embodiments, a polynucleotide motif of a certain structure may be inserted within another polynucleotide sequence (e.g. extension of the hairpin structure in guide RNA). In some embodiments, the linking nucleotides may be naturally occurring nucleotides. In some embodiments, the linking nucleotides may be non-naturally occurring nucleotides.

A "promoter" is a nucleotide sequence that controls or regulates the transcription of a nucleotide sequence (e.g., a coding sequence) that is operably associated with the promoter. The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. A promoter may comprise other elements that act as regulators of gene expression; e.g., a promoter region. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in Genetic Engineering of Plants, T. Kosuge, C. Meredith and A. Hollaender (eds.), Plenum Press, pp. 211-227). In some embodiments, a promoter region may comprise at least one intron (e.g., SEQ ID NO:1 or SEQ ID NO:2).

Promoters useful with this invention can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a promoter functional in a plant may be used with the constructs of this invention. Non-limiting examples of a promoter useful for driving expression in a plant include the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. Gene 403:132-142 (2007); Li et al. *Mol. Biol. Rep.* 37:1143-1154 (2010)). PrbcS1 and Pactin are constitutive promoters and Pnr and Pdca1 are inducible promoters. Pnr is induced by nitrate and repressed by ammonium (Li et al. *Gene* 403:132-142 (2007)) and Pdca1 is induced by salt (Li et al. *Mol. Biol. Rep.* 37:1143-1154 (2010)). In some embodiments, a promoter useful with this invention is RNA polymerase II (Pol II) promoter. In some embodiments, a U6 promoter or a 7SL promoter from *Zea mays* may be useful with constructs of this invention. In some embodiments, the U6c promoter and/or 7SL promoter from *Zea mays* may be useful for driving expression of a guide nucleic acid. In some embodiments, a U6c promoter, U6i promoter and/or 7SL promoter from *Glycine max* may be useful with constructs of this invention. In some embodiments, the U6c promoter, U6i promoter and/or 7SL promoter from *Glycine max* may be useful for driving expression of a guide nucleic acid.

Examples of constitutive promoters useful for plants include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci USA* 84:5745-5749), Adh promoter (Walker et al. (1987) *Proc. Natl. Acad. Sci. USA* 84:6624-6629), sucrose synthase promoter (Yang & Russell (1990) *Proc. Natl. Acad. Sci. USA* 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. *Plant Science* 79: 87-94), maize (Christensen et al., 1989. *Plant Molec. Biol.* 12: 619-632), and *arabidopsis* (Norris et al. 1993. *Plant Molec. Biol.* 21:895-906). The maize ubiquitin promoter (UbiP) has been developed in transgenic monocot systems and its sequence and vectors constructed for monocot transformation are disclosed in the European patent publication EP0342926. The ubiquitin promoter is suitable for the expression of the nucleotide sequences of the invention in transgenic plants, especially monocotyledons. Further, the promoter expression cassettes described by McElroy et al. (*Mol. Gen. Genet.* 231: 150-160 (1991)) can be easily modified for the expression of the nucleotide sequences of the invention and are particularly suitable for use in monocotyledonous hosts.

In some embodiments, tissue specific/tissue preferred promoters can be used for expression of a heterologous polynucleotide in a plant cell. Tissue specific or preferred expression patterns include, but are not limited to, green tissue specific or preferred, root specific or preferred, stem specific or preferred, flower specific or preferred or pollen specific or preferred. Promoters suitable for expression in green tissue include many that regulate genes involved in photosynthesis and many of these have been cloned from both monocotyledons and dicotyledons. In one embodiment, a promoter useful with the invention is the maize PEPC promoter from the phosphoenol carboxylase gene (Hudspeth & Grula, *Plant Molec. Biol.* 12:579-589 (1989)). Non-limiting examples of tissue-specific promoters include those associated with genes encoding the seed storage proteins (such as 0-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) *Seed Sci. Res.* 1:209-219; as well as EP Patent No. 255378). Tissue-specific or tissue-preferential promoters useful for the expression of the nucleotide sequences of the invention in plants, particularly maize, include but are not limited to those that direct expression in root, pith, leaf or pollen. Such promoters are disclosed, for example, in WO 93/07278, incorporated by reference herein for its disclosure of promoters. Other non-limiting examples of tissue specific or tissue preferred promoters useful with the invention the cotton rubisco promoter disclosed in U.S. Pat. No. 6,040,504; the rice sucrose synthase promoter disclosed in U.S. Pat. No. 5,604,121; the root specific promoter described by de Framond (*FEBS* 290:103-106 (1991); European patent EP0452269 to Ciba-Geigy); the stem specific promoter described in U.S. Pat. No. 5,625,136 (to Ciba-Geigy) and which drives expression of the maize trpA gene; the cestrum yellow leaf curling virus promoter disclosed in WO 01/73087; and pollen specific or preferred promoters including, but not limited to, ProOsLPS10 and ProOsLPS11 from rice (Nguyen et al. *Plant Biotechnol. Reports* 9(5):297-306 (2015)), ZmSTK2_USP from maize (Wang et al. *Genome* 60(6):485-495 (2017)), LAT52 and LAT59 from tomato (Twell et al. *Development* 109(3):705-713 (1990)), Zm13 (U.S. Pat. No. 10,421,972), PLA$_2$-δ promoter from *arabidopsis* (U.S. Pat. No. 7,141,424), and/or the ZmC5 promoter from maize (International PCT Publication No. WO1999/042587.

Additional examples of plant tissue-specific/tissue preferred promoters include, but are not limited to, the root hair-specific cis-elements (RHEs) (Kim et al. The Plant Cell 18:2958-2970 (2006)), the root-specific promoters RCc3 (Jeong et al. *Plant Physiol.* 153:185-197 (2010)) and RB7 (U.S. Pat. No. 5,459,252), the lectin promoter (Lindstrom et al. (1990) *Der. Genet.* 11:160-167; and Vodkin (1983) *Prog. Clin. Biol. Res.* 138:87-98), corn alcohol dehydrogenase 1 promoter (Dennis et al. (1984) *Nucleic Acids Res.* 12:3983-4000), S-adenosyl-L-methionine synthetase (SAMS) (Vander Mijnsbrugge et al. (1996) *Plant and Cell Physiology,* 37(8):1108-1115), corn light harvesting complex promoter (Bansal et al. (1992) *Proc. Natl. Acad. Sci. USA* 89:3654-3658), corn heat shock protein promoter (O'Dell et al. (1985) *EMBO J.* 5:451-458; and Rochester et al. (1986) *EMBO J.* 5:451-458), pea small subunit RuBP carboxylase promoter (Cashmore, "Nuclear genes encoding the small subunit of ribulose-1,5-bisphosphate carboxylase" pp. 29-39 In: Genetic Engineering of Plants (Hollaender ed., Plenum Press 1983; and Poulsen et al. (1986) *Mol. Gen. Genet.* 205:193-200), Ti plasmid mannopine synthase promoter (Langridge et al. (1989) *Proc. Natl. Acad. Sci. USA* 86:3219-3223), Ti plasmid nopaline synthase promoter (Langridge et al. (1989), supra), petunia chalcone isomerase promoter (van Tunen et al. (1988) *EMBO J.* 7:1257-1263), bean glycine rich protein 1 promoter (Keller et al. (1989) *Genes Dev.* 3:1639-1646), truncated CaMV 35S promoter (O'Dell et al. (1985) *Nature* 313:810-812), potato patatin promoter (Wenzler et al. (1989) *Plant Mol. Biol.* 13:347-354), root cell promoter (Yamamoto et al. (1990) *Nucleic Acids Res.* 18:7449), maize zein promoter (Kriz et al. (1987) *Mol. Gen. Genet.* 207:90-98; Langridge et al. (1983) *Cell* 34:1015-1022; Reina et al. (1990) *Nucleic Acids Res.* 18:6425; Reina et al. (1990) *Nucleic Acids Res.* 18:7449; and Wandelt et al. (1989) *Nucleic Acids Res.* 17:2354), globulin-1 promoter (Belanger et al. (1991) *Genetics* 129:863-872), α-tubulin cab promoter (Sullivan et al. (1989) *Mol. Gen. Genet.* 215:431-440), PEPCase promoter (Hudspeth & Grula (1989) *Plant Mol. Biol.* 12:579-589), R gene complex-associated promoters (Chandler et al. (1989) *Plant Cell* 1:1175-1183), and chalcone synthase promoters (Franken et al. (1991) *EMBO J.* 10:2605-2612).

Useful for seed-specific expression is the pea vicilin promoter (Czako et al. (1992) *Mol. Gen. Genet.* 235:33-40; as well as the seed-specific promoters disclosed in U.S. Pat. No. 5,625,136. Useful promoters for expression in mature leaves are those that are switched at the onset of senescence, such as the SAG promoter from *Arabidopsis* (Gan et al. (1995) *Science* 270:1986-1988).

In addition, promoters functional in chloroplasts can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

Additional regulatory elements useful with this invention include, but are not limited to, introns, enhancers, termination sequences and/or 5' and 3' untranslated regions.

An intron useful with this invention can be an intron identified in and isolated from a plant and then inserted into an expression cassette to be used in transformation of a plant. As would be understood by those of skill in the art, introns can comprise the sequences required for self-excision and are incorporated into nucleic acid constructs/expression cassettes in frame. An intron can be used either as a spacer to separate multiple protein-coding sequences in one nucleic acid construct, or an intron can be used inside one protein-coding sequence to, for example, stabilize the mRNA. If they are used within a protein-coding sequence, they are inserted "in-frame" with the excision sites included. Introns may also be associated with promoters to improve or modify expression. As an example, a promoter/intron combination useful with this invention includes but is not limited to that of the maize Ubi1 promoter and intron.

Non-limiting examples of introns useful with the present invention include introns from the ADHI gene (e.g., Adh1-S introns 1, 2 and 6), the ubiquitin gene (Ubi1), the RuBisCO small subunit (rbcS) gene, the RuBisCO large subunit (rbcL) gene, the actin gene (e.g., actin-1 intron), the pyruvate dehydrogenase kinase gene (pdk), the nitrate reductase gene (nr), the duplicated carbonic anhydrase gene 1 (Tdca1), the psbA gene, the atpA gene, or any combination thereof.

An editing system useful with this invention can be any site-specific (sequence-specific) genome editing system now known or later developed, which system can introduce mutations in a target specific manner. For example, an editing system (e.g., site- or sequence-specific editing system) can include, but is not limited to, a CRISPR-Cas editing system, a meganuclease editing system, a zinc finger nuclease (ZFN) editing system, a transcription activator-like effector nuclease (TALEN) editing system, a base editing system and/or a prime editing system, each of which can comprise one or more polypeptides and/or one or more polynucleotides that when expressed as a system in a cell can modify (mutate) a target nucleic acid in a sequence specific manner. In some embodiments, an editing system (e.g., site- or sequence-specific editing system) can comprise one or more polynucleotides and/or one or more polypeptides, including but not limited to a nucleic acid binding polypeptide (DNA binding domain), a nuclease, and/or other polypeptide, and/or a polynucleotide.

In some embodiments, an editing system can comprise one or more sequence-specific nucleic acid binding polypeptides (e.g., DNA binding domains) that can be from, for example, a polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein. In some embodiments, an editing system can comprise one or more cleavage domains (e.g., nucleases) including, but not limited to, an endonuclease (e.g., Fok1), a polynucleotide-guided endonuclease, a CRISPR-Cas endonuclease (e.g., CRISPR-Cas effector protein), a zinc finger nuclease, and/or a transcription activator-like effector nuclease (TALEN).

A "nucleic acid binding protein" or "nucleic acid binding polypeptide" as used herein refers to a polypeptide that binds and/or is capable of binding a nucleic acid in a site- and/or sequence specific manner. In some embodiments, a nucleic acid binding polypeptide comprises a DNA binding domain. In some embodiments, a nucleic acid binding polypeptide may be a sequence-specific nucleic acid binding polypeptide (e.g., a sequence-specific DNA binding domain) such as, but not limited to, a sequence-specific binding polypeptide and/or domain from, for example, a polynucleotide-guided endonuclease, a CRISPR-Cas effector protein (e.g., a CRISPR-Cas endonuclease), a zinc finger nuclease, a transcription activator-like effector nuclease (TALEN) and/or an Argonaute protein. In some embodiments, a nucleic acid binding polypeptide comprises a cleavage polypeptide (e.g., a nuclease polypeptide and/or domain) such as, but not limited to, an endonuclease (e.g., Fok1), a polynucleotide-guided endonuclease, a CRISPR-Cas endonuclease, a zinc finger nuclease, and/or a transcription activator-like effector nuclease (TALEN). In some embodiments, the nucleic acid binding polypeptide associates with and/or is capable of associating with (e.g., forms a complex with) one or more nucleic acid molecule(s) (e.g., forms a complex with a guide nucleic acid as described herein) that can direct or guide the nucleic acid binding polypeptide to a specific target nucleotide sequence (e.g., a gene locus of a genome) that is complementary to the one or more nucleic acid molecule(s) (or a portion or region thereof), thereby causing the nucleic acid binding polypeptide to bind to the nucleotide sequence at the specific target site. In some embodiments, the nucleic acid binding polypeptide is a CRISPR-Cas effector protein as described herein. In some embodiments, reference is made to specifically to a CRISPR-Cas effector protein for simplicity, but a nucleic acid binding polypeptide as described herein may be used.

In some embodiments, a polynucleotide and/or a nucleic acid construct of the invention can be an "expression cassette" or can be comprised within an expression cassette. As used herein, "expression cassette" means a recombinant nucleic acid molecule comprising, for example, a nucleic acid construct of the invention (e.g., a polynucleotide encoding a nucleic acid binding polypeptide (e.g., a CRISPR-Cas effector protein), a polynucleotide encoding an *Agrobacterium* effector protein, a polynucleotide encoding a DNA dependent polymerase polypeptide or domain thereof, and/ or a polynucleotide encoding a 5'-3' exonuclease polypeptide or domain thereof, and/or a guide nucleic acid), wherein nucleic acid construct is/are operably associated with one or more control sequences (e.g., a promoter, terminator and the like). Thus, in some embodiments, one or more expression cassettes may be provided, which are designed to express, for example, a nucleic acid construct of the invention (e.g., a nucleic acid construct of the invention encoding a nucleic acid binding polypeptide, an *Agrobacterium* effector protein, a DNA dependent DNA polymerase polypeptide or domain thereof, and/or 5'-3' exonuclease polypeptide or domain thereof, and the like, or comprising a T-DNA sequence, and/or a guide nucleic acid, and the like). When an expression cassette of the present invention comprises more than one polynucleotide, the polynucleotides may be operably linked to a single promoter that drives expression of all of the polynucleotides or the polynucleotides may be operably linked to one or more separate promoters (e.g., three polynucleotides may be driven by one, two or three promoters in any combination), which may be the same or different from each other. When two or more separate promoters are used, the promoters may be the same promoter or they may be different promoters. Thus, a polynucleotide encoding a sequence nucleic binding domain, a polynucleotide encoding an *Agrobacterium* effector protein, a polynucleotide encoding a DNA dependent polymerase polypeptide or domain thereof, and/or a polynucleotide encoding a 5'-3' exonuclease polypeptide or domain thereof, a T-DNA sequence, and/or a guide nucleic acid when comprised in a single expression cassette may each be operably linked to a single promoter, or separate promoters in any combination.

In some embodiments, an expression cassette comprising the polynucleotides/nucleic acid constructs of the invention may be optimized for expression in an organism (e.g., an animal, a plant, a bacterium and the like).

An expression cassette comprising a nucleic acid construct of the invention may be chimeric, meaning that at least one of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette can optionally include a transcriptional and/or translational termination region (i.e., termination region) and/or an enhancer region that is functional in the selected host cell. A variety of transcriptional terminators and enhancers are known in the art and are available for use in expression cassettes. Transcriptional terminators are responsible for the termination of transcription and correct mRNA polyadenylation. A termination region and/or the enhancer region may be native to the transcriptional initiation region, may be native to, for example, a gene encoding a nucleic acid binding protein, a gene encoding a DNA-dependent DNA polymerase, a gene encoding a domain is capable of interacting with a T-DNA sequence, and the like, or may be native to a host cell, or may be native to another source (e.g., foreign or heterologous to the promoter, to a gene encoding a nucleic acid binding protein, a gene encoding a DNA-dependent DNA polymerase, a gene encoding a domain is capable of interacting with a T-DNA sequence, and the like, or to the host cell, or any combination thereof).

An expression cassette of the invention also can include a polynucleotide encoding a selectable marker, which can be used to select a transformed host cell. As used herein, "selectable marker" means a polynucleotide sequence that when expressed imparts a distinct phenotype to the host cell expressing the marker and thus allows such transformed cells to be distinguished from those that do not have the marker. Such a polynucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

The expression cassettes, the nucleic acid molecules/ constructs and polynucleotide sequences described herein can be used in connection with vectors. The term "vector" refers to a composition for transferring, delivering or introducing a nucleic acid (or nucleic acids) into a cell. A vector comprises a nucleic acid construct (e.g., expression cassette(s)) comprising the nucleotide sequence(s) to be transferred, delivered or introduced. Vectors for use in transformation of host organisms are well known in the art. Non-limiting examples of general classes of vectors include viral vectors, plasmid vectors, phage vectors, phagemid vectors, cosmid vectors, fosmid vectors, bacteriophages, artificial chromosomes, minicircles, or *Agrobacterium* binary vectors in double or single stranded linear or circular form which may or may not be self transmissible or mobilizable. In some embodiments, a viral vector can include, but is not limited to, a retroviral, lentiviral, adenoviral, adeno-associated, or herpes simplex viral vector. A vector as defined herein can transform a prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter and/or other regulatory elements and in the case of cDNA this may be under the control of an appropriate promoter and/or other regulatory elements for expression in the host cell. Accordingly, a nucleic acid construct of this invention and/or expression cassettes comprising the same may be comprised in vectors as described herein and as known in the art.

As used herein, "contact," "contacting," "contacted," and grammatical variations thereof, refer to placing the components of a desired reaction together under conditions suitable for carrying out the desired reaction (e.g., transformation, transcriptional control, genome editing, nicking, and/or cleavage). Thus, for example, a target nucleic acid may be contacted with a nucleic acid construct of the invention encoding, for example, a nucleic acid binding polypeptide (e.g., a DNA binding domain such as a sequence-specific DNA binding protein (e.g., a polynucleotide-guided endonuclease, a CRISPR-Cas effector protein (e.g., CRISPR-Cas endonuclease), a zinc finger effector protein, meganuclease, and/or a transcription activator-like effector (TALE) protein (e.g., a TALE nuclease (TALEN), and/or an Argonaute protein) and a DNA-dependent DNA polymerase and/or a T-DNA sequence or a nucleic acid construct encoding the same, under conditions whereby the nucleic acid binding protein and the DNA-dependent DNA polymerase are expressed and the nucleic acid binding protein binds to the target nucleic acid, and the DNA-dependent DNA polymerase is either fused to the nucleic acid binding protein or is recruited to the nucleic acid binding protein (via, for example, a peptide tag fused to the nucleic acid binding protein and an affinity tag fused to the DNA-dependent DNA polymerase) and thus, the DNA-dependent DNA polymerase is positioned in the vicinity of the target nucleic acid, thereby modifying the target nucleic acid. Other methods for recruiting a DNA-dependent DNA polymerase may be used that take advantage of other protein-protein interactions, and also RNA-protein interactions and chemical interactions may be used. As another example, the constructs of the invention may be engineered into an *Agrobacterium* cell (e.g., such that they are expressed in an *Agrobacterium* cell and/or present in a plasmid and/or T-DNA that is in an *Agrobacterium* cell) and a plant cell may be contacted with the engineered *Agrobacterium* cell, wherein the plant cell is infected/transformed with the *Agrobacterium*, thereby modifying a target nucleic acid of the plant cell. In some embodiments, a nucleic acid binding protein (e.g., a CRISPR-Cas effector protein), a guide nucleic acid, and an *Agrobacterium* effector protein contact a target nucleic acid to thereby modify the nucleic acid. In some embodiments, a nucleic acid binding protein (e.g., a CRISPR-Cas effector protein), a guide nucleic acid, an *Agrobacterium* effector protein, a DNA-dependent DNA polymerase, and optionally a T-DNA contact a target nucleic acid to thereby modify the nucleic acid. In some embodiments, the nucleic acid binding protein, a guide nucleic acid, and/or an *Agrobacterium* effector protein may be in the form of a complex (e.g., a ribonucleoprotein such as an assembled ribonucleoprotein complex) and the complex contacts the target nucleic acid. In some embodiments, the complex or a component thereof (e.g., the guide nucleic acid) hybridizes to the target nucleic acid and thereby the target nucleic acid is modified (e.g., via action of the nucleic acid binding protein such as a CRISPR-Cas effector protein). In some embodiments, the *Agrobacterium* effector protein, DNA-dependent DNA polymerase, T-DNA, and/or nucleic acid binding polypeptide localize at the target nucleic acid, optionally through covalent and/or non-covalent interactions.

As used herein, "modifying" or "modification" in reference to a target nucleic acid includes editing (e.g., mutating), covalent modification, exchanging/substituting nucleic acids/nucleotide bases, deleting, cleaving, nicking, and/or transcriptional control of a target nucleic acid to thereby provide a modified nucleic acid. In some embodiments, a modification may include an insertion and/or deletion of any size and/or a single base change (SNP) of any type. In some embodiments, a modification comprises a SNP. In some embodiments, a modification comprises exchanging and/or substituting one or more (e.g., 1, 2, 3, 4, 5, or more) nucleotides. In some embodiments, an insertion or deletion may be about 1 base to about 30,000 bases in length (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 20,500, 21,000, 21,500, 22,000, 22,500, 23,000, 23,500, 24,000, 24,500, 25,000, 25,500, 26,000, 26,500, 27,000, 27,500, 28,000, 28,500, 29,000, 29,500, 30,000 bases in length or more, or any value or range therein). Thus, in some embodiments, an insertion or deletion may be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300 to about 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000 bases in length, or any range or value therein; about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300 bases to about 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000 bases or more in length, or any value or range therein; about 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000 bases to about 2500, 3000, 3500, 4000, 4500, 5000, 5500, 6000, 6500, 7000, 7500, 8000, 8500, 9000, 9500, or 10,000 bases or more in length, or any value or range therein; or about 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, or 700 bases to about 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000, 2500, 3000, 3500, 4000, 4500, or 5000 bases or more in length, or any value or range therein. In some embodiments, an insertion or deletion may be about 1000, 1100, 1200, 1300, 1400, 1500, 1600, 1700, 1800, 1900, 2000, 2500, 3000, 3500, 4000, 4500, 5000, 5500, 6000, 6500, 7000, 7500, 8000, 8500, 9000, 9500, or 10,000 bases to about 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 20,500, 21,000, 21,500, 22,000, 22,500, 23,000, 23,500, 24,000, 24,500, 25,000, 25,500, 26,000, 26,500, 27,000, 27,500, 28,000, 28,500, 29,000, 29,500, or 30,000 bases or more in length, or any value or range therein.

In some embodiments, a nucleic acid construct of the invention (e.g., a polynucleotide encoding a CRISPR-Cas effector protein, a polynucleotide encoding a fusion protein of the present invention, and/or a guide nucleic acid and/or expression cassettes and/or vectors comprising the same) may be operably linked to at least one regulatory sequence, optionally, wherein the at least one regulatory sequence may be codon optimized for expression in a plant. In some embodiments, the at least one regulatory sequence may be, for example, a promoter, an operon, a terminator, or an enhancer. In some embodiments, the at least one regulatory sequence may be a promoter. In some embodiments, the regulatory sequence may be an intron. In some embodiments, the at least one regulatory sequence may be, for example, a promoter operably associated with an intron or a promoter region comprising an intron. In some embodiments, the at least one regulatory sequence may be, for example a ubiquitin promoter and its associated intron (e.g., *Medicago truncatula* and/or *Zea mays* and their associated introns). In some embodiments, the at least one regulatory sequence may be a terminator nucleotide sequence and/or an enhancer nucleotide sequence.

In some embodiments, a nucleic acid construct of the invention may be operably associated with a promoter region, wherein the promoter region comprises an intron, optionally wherein the promoter region may be a ubiquitin promoter and intron (e.g., a *Medicago* or a maize ubiquitin promoter and intron, e.g., SEQ ID NO:1 or SEQ ID NO:2). In some embodiments, the nucleic acid construct of the invention that is operably associated with a promoter region comprising an intron may be codon optimized for expression in a plant.

In some embodiments, a nucleic acid construct of the invention may encode one or more polypeptides of interest, optionally wherein the one or more polypeptides of interest may be codon optimized for expression in a plant.

As used herein, a "CRISPR-Cas effector protein" is a protein or polypeptide or domain thereof that cleaves, cuts, or nicks a nucleic acid, binds a nucleic acid (e.g., a target nucleic acid and/or a guide nucleic acid), and/or that identifies, recognizes, or binds a guide nucleic acid as defined herein. In some embodiments, a CRISPR-Cas effector protein may be an enzyme (e.g., a nuclease, endonuclease, nickase, etc.) or portion thereof and/or may function as an enzyme. In some embodiments, a CRISPR-Cas effector protein refers to a CRISPR-Cas nuclease polypeptide or domain thereof that comprises nuclease activity or in which the nuclease activity has been reduced or eliminated, and/or comprises nickase activity or in which the nickase has been reduced or eliminated, and/or comprises single stranded DNA cleavage activity (ss DNAse activity) or in which the ss DNAse activity has been reduced or eliminated, and/or comprises self-processing RNAse activity or in which the self-processing RNAse activity has been reduced or eliminated. A CRISPR-Cas effector protein may bind to a target nucleic acid. A CRISPR-Cas effector protein may be a Type I, II, III, IV, V, or VI CRISPR-Cas effector protein. In some embodiments, a CRISPR-Cas effector protein may be from a Type I CRISPR-Cas system, a Type II CRISPR-Cas system, a Type III CRISPR-Cas system, a Type IV CRISPR-Cas system, Type V CRISPR-Cas system, or a Type VI CRISPR-Cas system. In some embodiments, a CRISPR-Cas effector protein of the invention may be from a Type II CRISPR-Cas system or a Type V CRISPR-Cas system. In some embodiments, a CRISPR-Cas effector protein may be a Type II CRISPR-Cas effector protein, for example, a Cas9 effector protein. In some embodiments, a CRISPR-Cas effector protein may be Type V CRISPR-Cas effector protein, for example, a Cas12 effector protein. In some embodiments, a CRISPR-Cas effector protein may be devoid of a nuclear localization signal (NLS).

In some embodiments, a CRISPR-Cas effector protein may be or include, but is not limited to, a Cas9, C2c1, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cash, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5 nuclease, optionally wherein the CRISPR-Cas effector protein may be a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or Cas14c effector protein.

In some embodiments, a CRISPR-Cas effector protein useful with the invention may comprise a mutation in its nuclease active site (e.g., RuvC, HNH, e.g., RuvC site of a Cas12a nuclease domain; e.g., RuvC site and/or HNH site of a Cas9 nuclease domain). A CRISPR-Cas effector protein having a mutation in its nuclease active site, and therefore, no longer comprising nuclease activity, is commonly referred to as "dead," e.g., dCas9. In some embodiments, a CRISPR-Cas effector protein domain or polypeptide having a mutation in its nuclease active site may have impaired activity or reduced activity as compared to the same CRISPR-Cas effector protein without the mutation, e.g., a nickase, e.g, Cas9 nickase, Cas12a nickase.

A CRISPR Cas9 effector protein or CRISPR Cas9 effector domain useful with this invention may be any known or later identified Cas9 nuclease. In some embodiments, a CRISPR Cas9 polypeptide can be a Cas9 polypeptide from, for example, *Streptococcus* spp. (e.g., *S. pyogenes*, *S. thermophiles*), *Lactobacillus* spp., *Bifidobacterium* spp., *Kandleria* spp., *Leuconostoc* spp., *Oenococcus* spp., *Pediococcus* spp., *Weissella* spp., and/or *Olsenella* spp. In some embodiments, a CRISPR-Cas effector protein may be a Cas9 polypeptide or domain thereof and optionally may have a nucleotide sequence of any one of SEQ ID NOs:3-13 or SEQ ID NOs:221-224 and/or an amino acid sequence of any one of SEQ ID NOs:14-15.

In some embodiments, the CRISPR-Cas effector protein may be a Cas9 polypeptide derived from *Streptococcus pyogenes* and recognizes the PAM sequence motif NGG, NAG, NGA (Mali et al, Science 2013; 339(6121): 823-826). In some embodiments, the CRISPR-Cas effector protein may be a Cas9 polypeptide derived from *Streptococcus thermophiles* and recognizes the PAM sequence motif NGGNG and/or NNAGAAW (W=A or T) (See, e.g., Horvath et al, Science, 2010; 327(5962): 167-170, and Deveau et al, J Bacteriol 2008; 190(4): 1390-1400). In some embodiments, the CRISPR-Cas effector protein may be a Cas9 polypeptide derived from *Streptococcus mutans* and recognizes the PAM sequence motif NGG and/or NAAR (R=A or G) (See, e.g., Deveau et al, J BACTERIOL 2008; 190(4): 1390-1400). In some embodiments, the CRISPR-Cas effector protein may be a Cas9 polypeptide derived from *Streptococcus aureus* and recognizes the PAM sequence motif NNGRR (R=A or G). In some embodiments, the CRISPR-Cas effector protein may be a Cas9 protein derived from *S. aureus*, which recognizes the PAM sequence motif N GRRT (R=A or G). In some embodiments, the CRISPR-Cas effector protein may be a Cas9 polypeptide derived from *S. aureus*, which recognizes the PAM sequence motif N GRRV (R=A or G). In some embodiments, the CRISPR-Cas effector protein may be a Cas9 polypeptide that is derived from *Neisseria meningitidis* and recognizes the PAM sequence motif N GATT or N GCTT (R=A or G, V=A, G or C) (See, e.g., Hou et ah, PNAS 2013, 1-6). In the aforementioned embodiments, N can be any nucleotide residue, e.g., any of A, G, C or T. In some embodiments, the CRISPR-Cas effector protein may be a Cas13a protein derived from *Leptotrichia shahii*, which recognizes a protospacer flanking sequence (PFS) (or RNA PAM (rPAM)) sequence motif of a single 3' A, U, or C, which may be located within the target nucleic acid.

A Type V CRISPR-Cas effector protein useful with embodiments of the invention may be any Type V CRISPR-Cas nuclease. A Type V CRISPR-Cas nuclease useful with this invention as an effector protein can include, but is not limited, to Cas12a (Cpf1), Cas12b, Cas12c (C2c3), Cas12d (CasY), Cas12e (CasX), Cas12g, Cas12h, Cas12i, C2c1, C2c4, C2c5, C2c8, C2c9, C2c10, Cas14a, Cas14b, and/or Cas14c nuclease. In some embodiments, a Type V CRISPR-Cas nuclease polypeptide or domain useful with embodiments of the invention may be a Cas12a polypeptide or domain. In some embodiments, a Type V CRISPR-Cas effector protein or domain useful with embodiments of the invention may be a nickase, optionally, a Cas12a nickase. In some embodiments, a CRISPR-Cas effector protein may be a Cas12a polypeptide or domain thereof and optionally may have an amino acid sequence of any one of SEQ ID NOs:16-32 and/or a nucleotide sequence of any one of SEQ ID NOs:33-35.

In some embodiments, the CRISPR-Cas effector protein may be derived from Cas12a, which is a Type V Clustered Regularly Interspaced Short Palindromic Repeats (CRISPR)-Cas nuclease. Cas12a differs in several respects from the more well-known Type II CRISPR Cas9 nuclease. For example, Cas9 recognizes a G-rich protospacer-adjacent motif (PAM) that is 3' to its guide RNA (gRNA, sgRNA, crRNA, crDNA, CRISPR array) binding site (protospacer, target nucleic acid, target DNA) (3'-NGG), while Cas12a recognizes a T-rich PAM that is located 5' to the target nucleic acid (5'-TTN, 5'-TTTN. In fact, the orientations in which Cas9 and Cas12a bind their guide RNAs are very nearly reversed in relation to their N and C termini. Furthermore, Cas12a enzymes use a single guide RNA (gRNA, CRISPR array, crRNA) rather than the dual guide RNA (sgRNA (e.g., crRNA and tracrRNA)) found in natural Cas9 systems, and Cas12a processes its own gRNAs. Additionally, Cas12a nuclease activity produces staggered DNA double stranded breaks instead of blunt ends produced by Cas9 nuclease activity, and Cas12a relies on a single RuvC domain to cleave both DNA strands, whereas Cas9 utilizes an HNH domain and a RuvC domain for cleavage.

A CRISPR Cas12a effector protein/domain useful with this invention may be any known or later identified Cas12a polypeptide (previously known as Cpf1) (see, e.g., U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided nuclease comprising a Cas12a polypeptide, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a domain or Cas12a polypeptide having a mutation in its nuclease active site, and therefore, no longer comprising nuclease activity, is commonly referred to as deadCas12a (e.g., dCas12a). In some embodiments, a Cas12a domain or Cas12a polypeptide having a mutation in its nuclease active site may have impaired activity, e.g., may have nickase activity.

In some embodiments, a CRISPR-Cas effector protein may be optimized for expression in an organism, for example, in an animal, a plant, a fungus, an archaeon, or a bacterium. In some embodiments, a CRISPR-Cas effector protein (e.g., Cas12a polypeptide/domain or a Cas9 polypeptide/domain) may be optimized for expression in a plant and/or for expression in an *Agrobacterium* strain.

A "guide nucleic acid," "guide RNA," "gRNA," "CRISPR RNA/DNA," "CRISPR guide nucleic acid," "crRNA" or "crDNA" as used herein means a nucleic acid that comprises at least one spacer sequence, which is complementary to (and hybridizes to) a target DNA (e.g., protospacer), and at least one repeat sequence (e.g., a repeat of a Type V Cas12a CRISPR-Cas system, or a fragment or portion thereof; a repeat of a Type II Cas9 CRISPR-Cas system, or fragment thereof; a repeat of a Type V C2c1 CRISPR Cas system, or a fragment thereof; a repeat of a CRISPR-Cas system of, for example, C2c3, Cas12a (also referred to as Cpf1), Cas12b, Cas12c, Cas12d, Cas12e, Cas13a, Cas13b, Cas13c, Cas13d, Cas1, Cas1B, Cas2, Cas3, Cas3', Cas3", Cas4, Cas5, Cash, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5, or a fragment thereof), wherein the repeat sequence may be linked to the 5' end and/or the 3' end of the spacer sequence. In some embodiments, the guide nucleic acid comprises DNA. In some embodiments, the guide nucleic acid comprises RNA. The design of a gRNA of this invention may be based on a Type I, Type II, Type III, Type IV, Type V, or Type VI CRISPR-Cas system.

In some embodiments, a Cas12a gRNA may comprise, from 5' to 3', a repeat sequence (full length or portion thereof ("handle"); e.g., pseudoknot-like structure) and a spacer sequence.

In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat, e.g., repeat-spacer-repeat-spacer-repeat-spacer-repeat-spacer-repeat-spacer, and the like). The guide nucleic acids of this invention are synthetic, human-made and not found in nature. A gRNA can be quite long and may be used as an aptamer (like in the MS2 recruitment strategy) or other RNA structures hanging off the spacer.

A "repeat sequence" as used herein, refers to, for example, any repeat sequence of a wild-type CRISPR Cas locus (e.g., a Cas9 locus, a Cas12a locus, a C2c1 locus, etc.) or a repeat sequence of a synthetic crRNA that is functional with the CRISPR-Cas effector protein encoded by the nucleic acid constructs of the invention. A repeat sequence useful with this invention can be any known or later identified repeat sequence of a CRISPR-Cas locus (e.g., Type I, Type II, Type III, Type IV, Type V or Type VI) or it can be a synthetic repeat designed to function in a Type I, II, III, IV, V or VI CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical to a repeat sequence from wild-type Type I CRISPR-Cas loci, Type II, CRISPR-Cas loci, Type III, CRISPR-Cas loci, Type IV CRISPR-Cas loci, Type V CRISPR-Cas loci and/or Type VI CRISPR-Cas loci. A repeat sequence from a wild-type CRISPR-Cas locus may be determined through established algorithms, such as using the CRISPRfinder offered through CRISPRdb (see, Grissa et al. *Nucleic Acids Res.* 35(Web Server issue):W52-7). In some embodiments, a repeat sequence or portion thereof is linked at its 3' end to the 5' end of a spacer sequence, thereby forming a repeat-spacer sequence (e.g., guide nucleic acid, guide RNA/DNA, crRNA, crDNA).

In some embodiments, a repeat sequence comprises, consists essentially of, or consists of at least 10 nucleotides depending on the particular repeat and whether the guide nucleic acid comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein; e.g., about). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% sequence identity (e.g., at least about 90%, 91%, 92%, 93%, 94%, 95%, 96%, 97%, 98%, 99%, or more) to the same region (e.g., 5' end) of a wild type CRISPR Cas repeat nucleotide sequence. In some embodiments, a portion of a repeat sequence may comprise a pseudoknot-like structure at its 5' end (e.g., "handle").

A "spacer sequence" as used herein is a nucleotide sequence that is complementary to a target nucleic acid (e.g., target DNA) (e.g, protospacer). The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a target nucleic acid. Thus, in some embodiments, the spacer sequence can have one, two, three, four, or five mismatches as compared to the target nucleic acid, which mismatches can be contiguous or noncontiguous. In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99% or 99.5% complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 21, 22, or 23 nucleotides in length.

In some embodiments, the 5' region of a spacer sequence of a guide nucleic acid may be identical to a target DNA, while the 3' region of the spacer may be substantially complementary to the target DNA (e.g., Type V CRISPR-Cas), or the 3' region of a spacer sequence of a guide nucleic acid may be identical to a target DNA, while the 5' region of the spacer may be substantially complementary to the target DNA (e.g., Type II CRISPR-Cas), and therefore, the overall complementarity of the spacer sequence to the target DNA may be less than 100%. Thus, for example, in a guide for a Type V CRISPR-Cas system, the first 1, 2, 3, 4, 5, 6, 7, 8, 9, 10 nucleotides in the 5' region (i.e., seed region) of, for example, a 20 nucleotide spacer sequence may be 100% complementary to the target DNA, while the remaining nucleotides in the 3' region of the spacer sequence are substantially complementary (e.g., at least about 70% complementary) to the target DNA. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target DNA.

As a further example, in a guide for a Type II CRISPR-Cas system, the first 1, 2, 3, 4, 5, 6, 7, 8, 9, 10 nucleotides in the 3' region (i.e., seed region) of, for example, a 20 nucleotide spacer sequence may be 100% complementary to the target DNA, while the remaining nucleotides in the 5' region of the spacer sequence are substantially complementary (e.g., at least about 70% complementary) to the target DNA. In some embodiments, the first 1 to 10 nucleotides (e.g., the first 1, 2, 3, 4, 5, 6, 7, 8, 9, 10 nucleotides, and any range therein) of the 3' end of the spacer sequence may be 100% complementary to the target DNA, while the remaining nucleotides in the 5' region of the spacer sequence are substantially complementary (e.g., at least about 50% complementary (e.g., at least about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or any range or value therein)) to the target DNA.

In some embodiments, a seed region of a spacer may be about 8 to about 10 nucleotides in length, about 5 to about 6 nucleotides in length, or about 6 nucleotides in length.

As used herein, a "target nucleic acid", "target DNA," "target nucleotide sequence," "target region," or "target region in the genome" refer to a region of an organism's genome that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide nucleic acid of this invention. A target region useful for a CRISPR-Cas system may be located immediately 3' (e.g., Type V CRISPR-Cas system) or immediately 5' (e.g., Type II CRISPR-Cas system) to a PAM sequence in the genome of the organism (e.g., a plant genome). A target region may be selected from any region of at least 15 consecutive nucleotides (e.g., 16, 17, 18, 19, 20, 21, 22, 23, 24, 25, 26, 27, 28, 29, 30 nucleotides, and the like) located immediately adjacent to a PAM sequence.

A "protospacer sequence" refers to the target double stranded DNA and specifically to the portion of the target DNA (e.g., or target region in the genome) that is fully or substantially complementary (and hybridizes) to the spacer sequence of the CRISPR repeat-spacer sequences (e.g., guide nucleic acids, CRISPR arrays, crRNAs).

In the case of Type V CRISPR-Cas (e.g., Cas12a) systems and Type II CRISPR-Cas (Cas9) systems, the protospacer sequence is flanked by (e.g., immediately adjacent to) a protospacer adjacent motif (PAM). For Type IV CRISPR-Cas systems, the PAM is located at the 5' end on the non-target strand and at the 3' end of the target strand (see below, as an example).

ral spacers to identify the original target DNA sequences in bacteriophages or plasmids and aligning these sequences to determine conserved sequences adjacent to the target sequence (Briner and Barrangou. 2014. *Appl. Environ. Microbiol.* 80:994-1001; Mojica et al. 2009. *Microbiology* 155:733-740).

"Recruit," "recruiting" or "recruitment" as used herein refer to attracting one or more polypeptide(s) or polynucleotide(s) to another polypeptide or polynucleotide (e.g., to a particular location in a genome) using protein-protein interactions, nucleic acid-protein interactions (e.g., RNA-protein interactions), and/or chemical interactions. Protein-protein interactions can include, but are not limited to, peptide tags (epitopes, multimerized epitopes) and corresponding affinity polypeptides, RNA recruiting motifs and corresponding affinity polypeptides, and/or chemical interactions. Example chemical interactions that may be useful with polypeptides and polynucleotides for the purpose of recruitment can include, but are not limited to, rapamycin-inducible dimerization of FRB-FKBP; Biotin-streptavidin interaction; SNAP tag (Hussain et al. *Curr Pharm Des.* 19(30):5437-42 (2013)); Halo tag (Los et al. *ACS Chem Biol.* 3 (6):373-82 (2008)); CLIP tag (Gautier et al. *Chemistry & Biology* 15:128-136 (2008)); DmrA-DmrC heterodimer induced by a compound (Tak et al. *Nat Methods* 14(12):1163-1166 (2017)); Bifunctional ligand approaches (fuse two protein-binding chemicals together) (Voβ et al. *Curr Opin Chemical Biology* 28:194-201 (2015)) (e.g. dihyrofolate reductase (DHFR) (Kopyteck et al. Cell Cehm Biol 7(5):313-321 (2000)).

A "recruiting motif" as used herein refers to one half of a binding pair that may be used to recruit a compound to which the recruiting motif is bound to another compound that includes the other half of the binding pair (i.e., a

```
5'-NNNNNNNNNNNNNNNNNNNN-3' RNA Spacer (SEQ ID NO: 36)
   ||||||||||||||||||||
3'AAANNNNNNNNNNNNNNNNNNNN-5' Target strand (SEQ ID NO: 37)
 ||||
5'TTTNNNNNNNNNNNNNNNNNNNN-3' Non-target strand (SEQ ID NO: 38)
```

In the case of Type II CRISPR-Cas (e.g., Cas9) systems, the PAM is located immediately 3' of the target region. The PAM for Type I CRISPR-Cas systems is located 5' of the target strand. There is no known PAM for Type III CRISPR-Cas systems. Makarova et al. describes the nomenclature for all the classes, types and subtypes of CRISPR systems (*Nature Reviews Microbiology* 13:722-736 (2015)). Guide structures and PAMs are described in by R. Barrangou (*Genome Biol.* 16:247 (2015)).

Canonical Cas12a PAMs are T rich. In some embodiments, a canonical Cas12a PAM sequence may be 5'-TTN, 5'-TTTN, or 5'-TTTV. In some embodiments, canonical Cas9 (e.g., *S. pyogenes*) PAMs may be 5'-NGG-3'. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natu- "corresponding motif"). The recruiting motif and corresponding motif may bind covalently and/or noncovalently. In some embodiments, a recruiting motif is an RNA recruiting motif (e.g., a RNA recruiting motif that is capable of binding and/or configured to bind an affinity polypeptide), an affinity polypeptide (e.g., an affinity polypeptide that is capable of binding and/or configured to bind an RNA recruiting motif and/or a peptide tag), or a peptide tag (e.g., a peptide tag that is capable of binding and/or configured to bind an affinity polypeptide). For example, when a recruiting motif is an RNA recruiting motif, the corresponding motif for the RNA recruiting motif may be an affinity polypeptide that binds the RNA recruiting motif. A further example is that when a recruiting motif is a peptide tag, the corresponding motif for the peptide tag may be an affinity polypeptide that binds the peptide tag. Thus, a compound (e.g., an *Agrobacterium* effector protein) comprising a recruiting motif (e.g., an affinity polypeptide) may be recruited to another compound (e.g., a guide nucleic acid) comprising a corresponding motif for the recruiting motif (e.g., an RNA recruiting motif).

As described herein, a "peptide tag" may be employed to recruit one or more polypeptides. A peptide tag may be any polypeptide that is capable of being bound by a corresponding motif such as an affinity polypeptide. A peptide tag may also be referred to as an "epitope" and when provided in multiple copies, a "multimerized epitope." Example peptide tags can include, but are not limited to, a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope. In some embodiments, a peptide tag may also include phosphorylated tyrosines in specific sequence contexts recognized by SH2 domains, characteristic consensus sequences containing phosphoserines recognized by 14-3-3 proteins, proline rich peptide motifs recognized by SH3 domains, PDZ protein interaction domains or the PDZ signal sequences, and an AGO hook motif from plants. Peptide tags are disclosed in WO2018/136783 and U.S. Patent Application Publication No. 2017/0219596, which are incorporated by reference for their disclosures of peptide tags. Peptide tags that may be useful with this invention can include, but are not limited to, SEQ ID NO:39 and SEQ ID NO:40. An affinity polypeptide useful with peptide tags includes, but is not limited to, SEQ ID NO:41.

Any epitope that may be linked to a polypeptide and for which there is a corresponding affinity polypeptide that may be linked to another polypeptide may be used with this invention as a peptide tag. In some embodiments, a peptide tag may comprise 1 or 2 or more copies of a peptide tag (e.g., repeat unit, multimerized epitope (e.g., tandem repeats)) (e.g., 1, 2, 3, 4, 5, 6, 7, 8, 9, 10, 11, 12, 13, 14, 15, 16, 17, 18, 19, 20, 21, 22, 23, 24, 25 or more repeat units. In some embodiments, an affinity polypeptide that interacts with/binds to a peptide tag may be an antibody. In some embodiments, the antibody may be a scFv antibody. In some embodiments, an affinity polypeptide that binds to a peptide tag may be synthetic (e.g., evolved for affinity interaction) including, but not limited to, an affibody, an anticalin, a monobody and/or a DARPin (see, e.g., Sha et al., *Protein Sci.* 26(5):910-924 (2017)); Gilbreth (*Curr Opin Struc Biol* 22(4):413-420 (2013)), U.S. Pat. No. 9,982,053, each of which are incorporated by reference in their entireties for the teachings relevant to affibodies, anticalins, monobodies and/or DARPins.

In some embodiments, a guide nucleic acid may be linked to an RNA recruiting motif, and a polypeptide to be recruited (e.g., a deaminase) may be fused to an affinity polypeptide that binds to the RNA recruiting motif, wherein the guide binds to the target nucleic acid and the RNA recruiting motif binds to the affinity polypeptide, thereby recruiting the polypeptide to the guide and contacting the target nucleic acid with the polypeptide (e.g., deaminase). In some embodiments, two or more polypeptides may be recruited to a guide nucleic acid, thereby contacting the target nucleic acid with two or more polypeptides (e.g., deaminases).

In some embodiments of the invention, a guide RNA may be linked to one or to two or more RNA recruiting motifs (e.g., 1, 2, 3, 4, 5, 6, 7, 8, 9, 10 or more motifs; e.g., at least 10 to about 25 motifs), optionally wherein the two or more RNA recruiting motifs may be the same RNA recruiting motif or different RNA recruiting motifs. In some embodiments, an RNA recruiting motif and a corresponding motif (e.g., a corresponding affinity polypeptide) may include, but is not limited to, a telomerase Ku binding motif (e.g., Ku binding hairpin) and an affinity polypeptide of Ku (e.g., Ku heterodimer), a telomerase Sm7 binding motif and an affinity polypeptide of Sm7, an MS2 phage operator stem-loop and an affinity polypeptide of MS2 Coat Protein (MCP), a PP7 phage operator stem-loop and an affinity polypeptide of PP7 Coat Protein (PCP), an SfMu phage Com stem-loop and an affinity polypeptide of Com RNA binding protein, a PUF binding site (PBS) and an affinity polypeptide of Pumilio/fem-3 mRNA binding factor (PUF), and/or a synthetic RNA-aptamer and the aptamer ligand as the corresponding affinity polypeptide. In some embodiments, the RNA recruiting motif and corresponding affinity polypeptide may be an MS2 phage operator stem-loop and the affinity polypeptide MS2 Coat Protein (MCP). In some embodiments, the RNA recruiting motif and corresponding affinity polypeptide may be a PUF binding site (PBS) and the affinity polypeptide Pumilio/fem-3 mRNA binding factor (PUF). Exemplary RNA recruiting motifs and corresponding affinity polypeptides that may be useful with this invention can include, but are not limited to, SEQ ID NOs:42-52.

In some embodiments, the components for recruiting polypeptides and nucleic acids may include those that function through chemical interactions that may include, but are not limited to, rapamycin-inducible dimerization of FRB-FKBP; Biotin-streptavidin; SNAP tag; Halo tag; CLIP tag; DmrA-DmrC heterodimer induced by a compound; bifunctional ligand (e.g., fusion of two protein-binding chemicals together; e.g. dihydrofolate reductase (DHFR).

A peptide tag may comprise or be present in one copy or in 2 or more copies of the peptide tag (e.g., multimerized peptide tag or multimerized epitope) (e.g., about 2, 3, 4, 5, 6, 7, 8, 9, 10, 11, 12, 13, 14, 15, 16, 17, 18, 9, 20, 21, 22, 23, 24, or 25 or more peptide tags). When multimerized, the peptide tags may be fused directly to one another or they may be linked to one another via one or more amino acids (e.g., 1, 2, 3, 4, 5, 6, 7, 8, 9, 10, 11, 12, 13, 14, 15, 16, 17, 18, 19, 20 or more amino acids, optionally about 3 to about 10, about 4 to about 10, about 5 to about 10, about 5 to about 15, or about 5 to about 20 amino acids, and the like, and any value or range therein. Thus, in some embodiments, a CRISPR-Cas effector protein of the invention may comprise a CRISPR-Cas effector protein fused to one peptide tag or to two or more peptide tags, optionally wherein the two or more peptide tags are fused to one another via one or more amino acid residues. In some embodiments, a peptide tag useful with the invention may be a single copy of a GCN4 peptide tag or epitope or may be a multimerized GCN4 epitope comprising about 2 to about 25 or more copies of the peptide tag (e.g., about 2, 3, 4, 5, 6, 7, 8, 9, 10, 11, 12, 13, 14, 15, 16, 17, 18, 19, 20, 21, 22, 23, 24, 25 or more copies of a GCN4 epitope or any range therein).

In some embodiments, a peptide tag may be fused to a polypeptide (e.g., a CRISPR-Cas effector protein or bacterial transfer protein). In some embodiments, a peptide tag may be fused or linked to the C-terminus of a polypeptide (e.g., a CRISPR-Cas effector protein or bacterial transfer protein) to form a fusion protein. In some embodiments, a peptide tag may be fused or linked to the N-terminus of a polypeptide (e.g., a CRISPR-Cas effector protein or bacterial transfer protein) to form a fusion protein. In some embodiments, a peptide tag may be fused within a polypeptide (e.g., a CRISPR-Cas effector protein or bacterial transfer protein); for example, a peptide tag may be in a loop region of a CRISPR-Cas effector protein.

In some embodiments, when a peptide tag comprises more than one peptide tag, the quantity and spacing of each peptide tag may be optimized to maximize occupation of the peptide tags and minimize steric interference of, for example, deaminase domains, with each other.

An "affinity polypeptide" (e.g., "recruiting polypeptide") refers to any polypeptide that is capable of binding to its corresponding peptide tag, peptide tag, or RNA recruiting motif. An affinity polypeptide for a peptide tag may be, for example, an antibody and/or a single chain antibody that specifically binds the peptide tag, respectively. In some embodiments, an antibody for a peptide tag may be, but is not limited to, an scFv antibody. In some embodiments, an affinity polypeptide may be fused or linked to the N-terminus of a deaminase (e.g., a cytosine deaminase or an adenine deaminase). In some embodiments, the affinity polypeptide is stable under the reducing conditions of a cell or cellular extract.

"Introducing," "introduce," "introduced" (and grammatical variations thereof) in the context of a polynucleotide and/or polypeptide of interest means presenting a nucleotide sequence of interest (e.g., polynucleotide, a nucleic acid construct, and/or a guide nucleic acid) and/or polypeptide of interest to a host organism or cell of said organism (e.g., host cell; e.g., a plant cell) in such a manner that the nucleotide sequence and/or polypeptide gains access to the interior of a cell. Thus, for example, a nucleic acid construct of the invention encoding a nucleic acid binding protein (e.g., a CRISPR-Cas effector protein), a guide nucleic acid, and/or an *Agrobacterium* effector protein may be introduced into a cell of an organism, thereby transforming the cell with the CRISPR-Cas effector protein, guide nucleic acid, and/or *Agrobacterium* effector protein. In some embodiments, a polypeptide comprising a nucleic acid binding protein (e.g., a CRISPR-Cas effector protein) and/or an *Agrobacterium* effector protein and/or a guide nucleic acid may be introduced into a cell of an organism, optionally wherein the nucleic acid binding protein and guide nucleic acid may be comprised in a complex (e.g., a ribonucleoprotein).

The terms "transformation" or "transfection" may be used interchangeably and as used herein refer to the introduction of a heterologous nucleic acid into a cell. Transformation of a cell may be stable or transient. Thus, in some embodiments, a host cell or host organism may be stably transformed with a polynucleotide/nucleic acid molecule of the invention. In some embodiments, a host cell or host organism may be transiently transformed with a nucleic acid construct of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

The terms "transgene" or "transgenic" as used herein refer to at least one nucleic acid sequence that is taken from the genome of one organism, or produced synthetically, and which is then introduced into a host cell (e.g., a plant cell) or organism or tissue of interest and which is subsequently integrated into the host's genome by means of "stable" transformation or transfection approaches. In contrast, the term "transient" transformation or transfection or introduction refers to a way of introducing molecular tools including at least one nucleic acid (DNA, RNA, single-stranded or double-stranded or a mixture thereof) and/or at least one amino acid sequence, optionally comprising suitable chemical or biological agents, to achieve a transfer into at least one compartment of interest of a cell, including, but not restricted to, the cytoplasm, an organelle, including the nucleus, a mitochondrion, a vacuole, a chloroplast, or into a membrane, resulting in transcription and/or translation and/or association and/or activity of the at least one molecule introduced without achieving a stable integration or incorporation and thus inheritance of the respective at least one molecule introduced into the genome of a cell. The term "transgene-free" refers to a condition in which a transgene is not present or found in the genome of a host cell or tissue or organism of interest.

Accordingly, in some embodiments, nucleotide sequences, polynucleotides, nucleic acid constructs, and/or expression cassettes of the invention may be expressed transiently and/or they can be stably incorporated into the genome of the host organism. Thus, in some embodiments, a nucleic acid construct of the invention (e.g., one or more expression cassettes encoding a nucleic acid binding protein, an DNA dependent DNA polymerase polypeptide or domain thereof, a domain is capable of interacting with a T-DNA sequence, a T-DNA sequence, and/or nucleic acid modifying polypeptide or domain thereof, and the like) may be transiently introduced into a cell with a guide nucleic acid and as such, no DNA is maintained in the cell.

A nucleic acid construct of the invention may be introduced into a cell (e.g., a plant cell) by any method known to those of skill in the art. In some embodiments, transformation methods include transformation via bacterial-mediated nucleic acid delivery (e.g., via Agrobacteria), viral-mediated nucleic acid delivery, silicon carbide and/or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. In some embodiments of the invention, transformation of a cell comprises nuclear transformation. In some embodiments, transformation of a cell comprises plastid transformation (e.g., chloroplast transformation). In some embodiments, a recombinant nucleic acid construct of the invention can be introduced into a cell via conventional breeding techniques. In some embodiments, one or more of polynucleotide(s), polypeptide(s), expression cassette(s), and/or vector(s) may be introduced into a plant cell via *Agrobacterium* transformation.

Procedures for transforming both eukaryotic and prokaryotic organisms are well known and routine in the art and are described throughout the literature (See, for example, Jiang et al. 2013. *Nat. Biotechnol.* 31:233-239; Ran et al. *Nature Protocols* 8:2281-2308 (2013)). General guides to various plant transformation methods known in the art include Miki et al. ("Procedures for Introducing Foreign DNA into Plants" in *Methods in Plant Molecular Biology and Biotechnology*, Glick, B. R. and Thompson, J. E., Eds. (CRC Press, Inc., Boca Raton, 1993), pages 67-88) and Rakowoczy-Trojanowska (*Cell. Mol. Biol.* Lett. 7:849-858 (2002)).

A polynucleotide/or polypeptide can be introduced into a host organism or its cell (optionally a plant, plant part, and/or plant cell) in any number of ways that are well known in the art. The methods of the invention do not depend on a particular method for introducing one or more nucleotide sequences into the organism (e.g., a plant), only that they gain access to the interior of at least one cell of the organism. When more than one polynucleotide is to be introduced, it can be assembled as part of a single nucleic acid construct, as separate nucleic acid constructs, can be located on the same or different nucleic acid constructs, and/or as a complex (e.g., a ribonucleoprotein). A polynucleotide and/or polypeptide can be introduced into the cell of interest in a single transformation event, or in separate transformation events, or, alternatively, a polynucleotide and/or polypeptide can be incorporated into a plant as part of a breeding protocol.

To perform precise templated editing in cells there are several steps, each of which has rate limitations that together can reduce the ability to effectively perform editing. These steps include: (1) inducing the cell to initiate a repair event at the target site. This is typically performed by causing a double-strand break (DSB) or nick by an exogenously provided, sequence-specific nuclease or nickase; (2) local availability of a homologous template to be used for the repair. This step requires the template to be in the proximity of the DSB at exactly the right time when the DSB is competent to commit to a templated editing pathway and is widely regarded to be the rate limiting step with current editing technologies; and (3) efficient incorporation of sequence from the template into the broken or nicked target. The efficiency of step (3) is often low and very difficult to manipulate. In some embodiments, the present invention effectively bypasses the major rate limiting step (2) above and/or the problem of manufacturing, delivering and incorporating long single-stranded DNA repair templates.

Single-stranded DNA templates have proven to be the most effective for introducing long edits and insertions in mammalian cells. However, these are inconvenient and expensive to manufacture, and difficult to deliver into plant cells. Embodiments of the present invention combine efficient template design with *Agrobacterium* transformation biology to recruit long, ssDNA molecules (T-DNAs) to the site of DSBs or nicks to make them locally abundant for use as templates. A peptide tag (i.e., epitope tag) can be fused to one or more virulence proteins of *Agrobacterium* (e.g., VirD2 or VirE2 proteins), which may be used as chaperones for the ss T-DNA into the plant cytoplasm. Such tagged virulence proteins can then be used to not only mediate the entry of the ssDNA into the nucleus but also recruit the T-DNA to the editing target with a nucleic acid binding protein fused to an antibody that recognizes the peptide tag. By making T-DNA molecules locally abundant at the site of the DSB, this invention greatly increases the frequency at which precise templated edits can be made in eukaryotic cells. It may be especially useful for making long templated edits and gene-sized insertions.

Using the natural biology of *Agrobacterium* in the T-DNA transfer process and combined with modern genome editing technologies allows the recruitment of a nucleic acid binding protein, a guide nucleic acid, and/or a T-DNA to the target site for use as a long, ssDNA repair template. Thus, this invention provides many advantages over currently available methods for editing (e.g., templated editing) in plants because it utilizes *Agrobacterium* (e.g., *Agrobacterium* delivery of a polynucleotide and/or polypeptide and/or utilizing an *Agrobacterium* nuclear localization signal), the preferred transformation vector for commercial plant pipelines due to its low cost, efficiency, and throughput. As far as the inventors are aware, no other high efficiency method for templated editing via *Agrobacterium* is available.

T-DNA is harbored within *Agrobacterium* cells on a double-stranded plasmid. The natural transfer process begins when VirD1 and VirD2 associate with the left and right borders of the T-DNA and nick it, releasing it from the parent plasmid as a ssDNA molecule. One molecule of the VirD2 protein remains covalently attached at Tyr29 to the 5'-end of the T-DNA and guides the T-DNA from the bacterial cytoplasm, through the bacterial Type IV secretion system, into the plant cell cytoplasm. Independently of the T-DNA, *Agrobacterium* also secretes the ssDNA binding protein VirE2 into the plant cell and this protein coats the T-DNA in the plant cell cytoplasm and helps chaperone it into the nucleus. Both VirD2 and VirE2 have nuclear localization signals, which may be involved in the transfer of the T-DNA into the nucleus. For more details on the process of T-DNA production and transfer see, K. Singer, *The Mechanism of T-DNA Integration: Some Major Unresolved Questions. Current Topics in Microbiology and Immunology*. Springer International Publishing AG. 418:287-317 (2018).

In some embodiments, the invention takes advantage of the escort activity that VirD2 (and other virulence proteins of *Agrobacterium* (e.g., VirE2)) naturally performs through the plant cell cytoplasm and into the nucleus. Due to the covalent bond between VirD2 and the 5'-end of the T-DNA, the inventors have identified VirD2 (e.g., its nuclear localization signal and/or sequence that binds T-DNA) and other bacterial transfer proteins (e.g., proteins involved in a type IV secretion system (T4SS) such as *Agrobacterium* virulence proteins) as being useful for a protein-protein interaction strategy to recruit a nucleic acid binding protein, a guide nucleic acid, and/or a T-DNA to a target site (e.g., a target nucleic acid) for modification at the target site. In some embodiments, a T-DNA is recruited to a target site for use as a repair template.

A "bacterial transfer protein" as used herein refers to a protein in bacteria or a polypeptide or domain thereof that is involved in the transfer of a nucleic acid (e.g., DNA or RNA, optionally a plasmid or T-DNA) from one cell to another cell, optionally during bacterial conjugation. A bacterial transfer protein may include all or a portion of a bacterial transfer protein. In some embodiments, a bacterial transfer protein is a wild-type bacterial transfer protein. In some embodiments, a bacterial transfer protein is a synthetic bacterial transfer protein (i.e., a bacterial transfer protein that is synthetically engineered to be different than a wild-type bacterial transfer protein). In some embodiments, a bacterial transfer protein is a bacterial protein involved in a type IV secretion system (T4SS). In some embodiments, a bacterial transfer protein comprises a nuclear localization signal and/or a T4SS secretion signal. In some embodiments, a bacterial transfer protein is capable of recruiting T-DNA to a target site as described herein. In some embodiments, a bacterial transfer protein is involved in bacterial conjugation. In some embodiments, a bacterial transfer protein is secreted into a host cell. Exemplary bacterial transfer proteins include, but are not limited to, an *Agrobacterium* protein (e.g., an *Agrobacterium tumefaciens* protein or an *Agrobacterium rhizogenes* protein), a *Helicobacter pylori* protein, an *Enterococcus* protein (e.g., an *Enterococcus faecalis* protein), an *Escherichia coli* protein, a *Legionella* protein (e.g., a *L. pneumophila* protein), a *Sinorhizobium* protein (e.g. *Sinorhizobium meliloti*), a *Rhizobium* protein (e.g. *Rhizobium* sp. NGR234 or *Rhizobium* MO, a *Mesorhizobium* protein (e.g. *Mesorhizobium loti*), a *Rickettsia* protein (e.g., a *R. prowazekii* protein or a *R. typhi* protein); an *Ensifer* protein (e.g., an *E. adhaerens* protein), and/or an *Ochrobactrum* protein (e.g., *Ochrobactrum haywardense*). In some embodiments, a bacterial transfer protein is an *Agrobacterium* effector protein. Further exemplary bacterial transfer proteins include, but are not limited to, (e.g., all or a portion of) VirD2, VirE2, VirF, VirE3, VirD5, GALLS, MobA, MobC-CloDF13, TraI-F, TraI-RP4, TraIR388, CagA-Cag, and/or RalF-Dot/Icm.

An "*Agrobacterium* effector protein" as used herein refers to an *Agrobacterium* protein or a polypeptide or domain thereof that is involved in the secretion of a nucleic acid (e.g., DNA or RNA, optionally a plasmid or T-DNA) from a bacterial cell to a host cell (e.g., a host eukaryotic cell). Thus, an *Agrobacterium* effector protein may include all or a portion of an *Agrobacterium* protein. In some embodiments, an *Agrobacterium* effector protein is a wild-type *Agrobacterium* protein. In some embodiments, an *Agrobacterium* effector protein is a synthetic *Agrobacterium* protein (i.e., an *Agrobacterium* effector protein that is synthetically engineered to be different than a wild-type *Agrobacterium* protein). In some embodiments, an *Agrobacterium* effector protein is capable of recruiting T-DNA to a target site as described herein. In some embodiments, an *Agrobacterium* effector protein is involved in bacterial conjugation. In some embodiments, an *Agrobacterium* effector protein is secreted into a host cell. Exemplary *Agrobacterium* effector proteins include, but are not limited to, VirD2, VirE2, VirF, VirE3, VirD5, and/or GALLS.

In some embodiments, a composition, system, complex, and/or method of the present invention comprises recruiting a T-DNA to a target (e.g., a nucleic acid binding protein) and/or target site (e.g., comprising a target nucleic acid), optionally wherein the T-DNA comprises a repair template (e.g., a homology repair template) that may be used for modifying a target nucleic acid. For example, a T-DNA may be recruited to a nucleic acid binding protein (e.g., via interaction of a recruiting motif and corresponding motif) and the nucleic acid binding protein in binding and/or forming a complex with a guide nucleic acid may be recruited to a target nucleic acid through interaction (e.g., binding) of the guide nucleic acid to a target site in the vicinity of and/or comprising the target nucleic acid. In some embodiments, the T-DNA may be recruited to the nucleic acid binding protein by the nucleic acid binding protein comprising a recruiting motif and a bacterial transfer protein comprising a corresponding motif and the bacterial transfer protein interacts (e.g., binds) to the T-DNA. In some embodiments, a composition, system, complex, and/or method of the present invention may provide a higher concentration of a T-DNA optionally comprising a repair template at a target site and/or target nucleic acid. Thus, in some embodiments, an increased, localized concentration of a T-DNA optionally comprising a repair template may be provided at a target site and/or a target nucleic acid according to a composition, system, complex, and/or method of the present invention compared to the concentration of a T-DNA overall in the cell and/or compared to the concentration of a T-DNA not in accordance with the present invention. In some embodiments, a composition, system, complex, and/or method of the present invention does not involve and/or is devoid of recruiting a T-DNA to a target site.

In some embodiments, a composition, system, complex, and/or method of the present invention comprises and/or is configured for providing homology directed repair. In some embodiments, a composition, system, complex, and/or method of the present invention provides and/or is configured for providing a modified nucleic acid, optionally wherein the cell and/or organism (e.g., plant) comprising the modified nucleic acid is transgene-free.

A bacterial transfer protein of the present invention may comprise a nuclear localization signal. In some embodiments, a bacterial transfer protein of the present invention comprises a T4SS secretion signal, optionally wherein the T4SS secretion signal comprises an amino acid sequence of SEQ ID NO:166 or 167. A bacterial transfer protein of the present invention may comprise an amino acid sequence having at least 70%, 75%, 80%, 85%, or 90% amino acid sequence similarity to SEQ ID NOs:166, 167, 168, 225, and/or 226. In some embodiments, the bacterial transfer protein of the present invention comprises an amino acid sequence of SEQ ID NOs:166, 167, 168, 225, and/or 226. A bacterial transfer protein of the present invention may have any suitable length. In some embodiments, a bacterial transfer protein of the present invention comprises about 1%, 2%, 5%, 10%, 15%, 20%, 25%, 30%, 35%, 40%, 45%, 50%, 55%, 60%, 65%, 70%, 75%, 80%, 85%, 90%, 95%, 97%, 98%, 99%, or 100% amino acids of a wild-type bacterial transfer protein. In some embodiments, a bacterial transfer protein of the present invention has a length of 5, 10, 15, or 20 amino acids to 25, 30, 35, 40, 45, or 50 amino acids. In some embodiments, a bacterial transfer protein of the present invention has a length of 10, 25, 50, 75, 100, or 150 amino acids to 175, 200, 225, 250, 275, 300, 325, 350, or 375 amino acids.

In some embodiments, the bacterial transfer protein is an *Agrobacterium* protein (e.g., an *Agrobacterium* virulence protein). In some embodiments, the bacterial transfer protein is VirD2 or VirE2, optionally for use in recruitment of a nucleic acid binding protein, a guide nucleic acid, and/or a T-DNA (e.g., a T-DNA comprising a repair template) to a target nucleic acid. A bacterial transfer protein may be fused to a nucleic acid binding protein and/or a guide nucleic acid. Fusion of a bacterial transfer protein to another polypeptide may not interfere with the protein's essential function(s) (e.g., release of the T-DNA strand from the plasmid, covalent attachment to the T-DNA strand, and/or secretion across the specific virulence (vir)-induced type IV secretion system (T4SS)).

As discussed above, VirE2 is secreted independently of T-DNA. VirE2 coats the ssT-DNA in the plant cell cytoplasm to which it has been transferred. Each VirE2 protein contains two nuclear-localization signals, which may be involved in transport of the T-DNA complex into the nucleus and as such may also be a good candidate for a fusion polypeptide of this invention.

In some embodiments, a nucleic acid binding protein (e.g., a sequence specific DNA binding protein) and a bacterial transfer protein (e.g., a virulence proteins such as VirD2, VirE2, etc.) originate in different compartments and are expected to locate each other and associate in the eukaryotic cell. Thus, non-covalent recruitment strategies such as a peptide tag system (e.g., a peptide tag and an affinity polypeptide that binds to the peptide tag) or a RNA recruiting motif system (e.g., a RNA recruiting motif and an affinity polypeptide that binds to the RNA recruiting motif) may be used to carry out this invention.

In some embodiments, to enable efficient integration of a T-DNA encoded edit into a plant genome, the T-DNA can have a single homology arm or two homology arms flanking the edit to exploit the cell's native homology-directed repair pathway. Alternatively, the T-DNA may have a short primer binding site with complementarity to a nicked genomic target for use in an application somewhat like "prime editing". Here, DNA-dependent DNA polymerase rather than reverse transcriptase may be utilized to incorporate the edit. In some embodiments, a T-DNA useful with the present invention may have microhomology flanking the desired edit, so as to be incorporated via the microhomology-mediated end joining pathway. In some embodiments, a T-DNA useful with this invention can be configured to integrate via the classical non-homologous end-joining pathway with ligation steps at each end to incorporate it into the genome.

Provided according to some embodiments is a fusion protein comprising a bacterial transfer protein and a recruiting motif (e.g., an affinity polypeptide, an RNA recruiting motif, or a peptide tag). Exemplary fusion proteins comprising a bacterial transfer protein and a recruiting motif include, but are not limited to, those of SEQ ID NOs:71, 175, 177, 178, 180-182, 184, 186, 188, 190-192, and/or 194. In some embodiments, the bacterial transfer protein comprises (e.g., all or a portion of) an *Agrobacterium* protein (e.g., an *Agrobacterium tumefaciens* protein or an *Agrobacterium rhizogenes* protein), a *Helicobacter pylori* protein, an *Enterococcus* protein (e.g., an *Enterococcus faecalis* protein), an *Escherichia coli* protein, a *Legionella* protein (e.g., a *L. pneumophila* protein), a *Sinorhizobium* protein (e.g. *Sinorhizobium meliloti*), a *Rhizobium* protein (e.g. *Rhizobium* sp. NGR234 or *Rhizobium* e), a *Mesorhizobium* protein (e.g. *Mesorhizobium loti*), a *Rickettsia* protein (e.g., a *R. prowazekii* protein or a *R. typhi* protein); an *Ensifer* protein (e.g., an *E. adhaerens* protein), and/or an *Ochrobactrum* protein (e.g., *Ochrobactrum haywardense*). In some embodiments, the bacterial transfer protein is a bacterial protein in a type IV secretion system. The bacterial transfer protein of the fusion protein may have any suitable length. In some embodiments, the bacterial transfer protein of the fusion protein has a length of 5, 10, 15, or 20 amino acids to 25, 30, 35, 40, 45, or 50 amino acids. In some embodiments, the bacterial transfer protein of the fusion protein has a length of 10, 25, 50, 75, 100, or 150 amino acids to 175, 200, 225, 250, 275, 300, 325, 350, or 375 amino acids. In some embodiments, the bacterial transfer protein of the fusion protein comprises all or a portion of a binding domain (e.g., a peptide/protein binding domain or DNA binding domain) and/or a nuclear localization signal (e.g., a T4SS secretion signal). In some embodiments, the bacterial transfer protein of the fusion protein comprises an amino acid sequence having at least 70%, 75%, 80%, 85%, or 90% amino acid sequence similarity to SEQ ID NOs:166, 167, 168, 225, and/or 226, optionally wherein the bacterial transfer protein comprises or is an amino acid sequence of SEQ ID NOs:166, 167, 168, 225, and/or 226. The bacterial transfer protein may comprise (e.g., all or a portion of) VirD2, VirE2, VirF, VirE3, VirD5, GALLS, MobA, MobC-CloDF13, TraI-F, TraI-RP4, TraIR388, CagA-Cag, and/or RalF-Dot/Icm. In some embodiments, the bacterial transfer protein comprises an *Agrobacterium* effector protein such as an *Agrobacterium* virulence protein (e.g., VirD2, VirE2, VirF, VirE3, VirD5, etc.).

The recruiting motif of the fusion protein may be fused to the N- or C-terminus of the bacterial transfer protein, optionally with a linker (e.g., a peptide linker) between the bacterial transfer protein and the recruiting motif. In some embodiments, the recruiting motif of the fusion protein may be fused within the bacterial transfer protein (e.g., in a loop region of the bacterial transfer protein), optionally with a linker (e.g., a peptide linker) between the bacterial transfer protein and the recruiting motif. A corresponding motif for the recruiting motif may be used to recruit the fusion protein to a target (e.g., a guide nucleic acid), a target site and/or a target nucleic acid. In some embodiments, the recruiting motif is an affinity polypeptide and optionally a peptide tag (e.g., a peptide tag fused to a nucleic acid binding protein) that binds to the affinity polypeptide may be used to recruit the fusion protein to a target (e.g., the nucleic acid binding protein), a target site, and/or a target nucleic acid. In some embodiments, the recruiting motif is a peptide tag and optionally an affinity polypeptide (e.g., an affinity polypeptide fused to a nucleic acid binding protein) that binds to the peptide tag may be used to recruit the fusion protein to a target (e.g., the nucleic acid binding protein), a target site and/or a target nucleic acid. In some embodiments, the recruiting motif is an affinity polypeptide and optionally a RNA recruiting motif (e.g., a RNA recruiting motif fused to a guide nucleic acid) that binds to the affinity polypeptide may be used to recruit the fusion protein to a target (e.g., the guide nucleic acid), a target site and/or a target nucleic acid.

A composition, system, kit or complex of the present invention may comprise a fusion protein including a bacterial transfer protein and a recruiting motif. In some embodiments, the composition, system, kit or complex comprises a guide nucleic acid which may comprise a corresponding motif for the recruiting motif. In some embodiments, the composition, system, kit or complex comprises a nucleic acid binding polypeptide (e.g., a CRISPR-Cas effector protein), which may comprise a corresponding motif for the recruiting motif. In some embodiments, the composition, system, kit or complex comprises a T-DNA, and the bacterial transfer protein of the fusion protein may interact with the T-DNA.

A method of the present invention may comprise contacting a target nucleic acid with a nucleic acid binding polypeptide, a guide nucleic acid, and a fusion protein including a bacterial transfer protein and a recruiting motif optionally to modify a target nucleic acid. In some embodiments, contacting the target nucleic acid comprises using a composition, system, kit or complex comprising the fusion protein to contact the target nucleic acid. In some embodiments, the nucleic acid binding polypeptide and the guide nucleic acid form a complex or are comprised in a complex. The complex may also comprise the fusion protein. In some embodiments, the guide nucleic acid comprises a corresponding motif (e.g., an RNA recruiting motif such as an RNA aptamer) for the recruiting motif of the fusion protein, and this corresponding motif may recruit the fusion protein to the guide nucleic acid and/or to the target nucleic acid. In some embodiments, the nucleic acid binding polypeptide comprises a corresponding motif for the recruiting motif of the fusion protein, and this corresponding motif may recruit the fusion protein to the nucleic acid binding polypeptide and/or to the target nucleic acid. In some embodiments, a method, composition, system, kit or complex of the present comprises a T-DNA (e.g., a T-DNA that is present in an *Agrobacterium* such as during the contacting step). When the T-DNA is present, the bacterial transfer protein of the fusion protein may interact with the T-DNA. In some embodiments, the method is devoid of T-DNA transfer. In some embodiments, the method of modifying the target nucleic acid does not require T-DNA transfer in order to induce modification and/or provide the modified target nucleic acid and/or the method comprises non-templated editing, PRIME editing and/or REDRAW of the target nucleic acid. The fusion protein, the nucleic acid binding polypeptide, and/or the guide nucleic acid may be expressed in *Agrobacterium* that is contacted to a cell to thereby modify a target nucleic acid present in the cell. In some embodiments, a nucleic acid (e.g., a plasmid and/or T-DNA) of the *Agrobacterium* encodes the fusion protein, the nucleic acid binding polypeptide and/or the guide nucleic acid. Upon contact of the *Agrobacterium* with a cell (e.g., a plant cell) the fusion protein, the nucleic acid binding polypeptide, and/or the guide nucleic acid (each of which may optionally be in a complex and/or which may be expressed in the *Agrobacterium* and/or encoded in a nucleic acid of the *Agrobacterium*) may be transported (e.g., secreted) into the cell comprising the target nucleic acid to thereby contact and modify the target nucleic acid. In some embodiments, an *Agrobacterium* cell expresses and/or encodes (e.g., on a plasmid such as a tumor inducing plasmid) the fusion protein, expresses and/or encodes (e.g., on the same or a different plasmid than the fusion protein) the nucleic acid binding polypeptide, and/or comprises the guide nucleic acid (e.g., on the same or different plasmid than the fusion protein and/or nucleic acid binding polypeptide) and, upon contact of the *Agrobacterium* cell and another cell (e.g., a plant cell), the expressed fusion protein, expressed nucleic acid binding polypeptide, and/or guide nucleic acid are transported (e.g., secreted) into the cell comprising a target nucleic acid to thereby modify the target nucleic acid. In some embodiments, the guide nucleic acid is encoded in a nucleic acid, plasmid or T-DNA of the *Agrobacterium* cell. In some embodiments, an *Agrobacterium* cell expresses the fusion protein, expresses the nucleic acid binding polypeptide, and/or comprises the guide nucleic acid and, upon contact of the *Agrobacterium* cell and another cell (e.g., a plant cell), the expressed fusion protein, expressed nucleic acid binding polypeptide, and/or guide nucleic acid are transported (e.g., secreted) into the cell comprising a target nucleic acid to thereby modify the target nucleic acid. In some embodiments, the fusion protein, the nucleic acid binding polypeptide, and/or the guide nucleic acid may be transported (e.g., secreted) via a Type IV secretion system into the cell.

Provided according to some embodiments is a fusion protein comprising a bacterial transfer protein and a nucleic acid binding polypeptide. Exemplary fusion proteins comprising a bacterial transfer protein and a nucleic acid binding polypeptide include, but are not limited to, those of SEQ ID NOs:65, 66, 69, and/or 70. In some embodiments, the bacterial transfer protein comprises (e.g., all or a portion of) an *Agrobacterium* protein (e.g., an *Agrobacterium tumefaciens* protein or an *Agrobacterium rhizogenes* protein), a *Helicobacter pylori* protein, an *Enterococcus* protein (e.g., an *Enterococcus faecalis* protein), an *Escherichia coli* protein, a *Legionella* protein (e.g., a *L. pneumophila* protein), a *Sinorhizobium* protein (e.g. *Sinorhizobium meliloti*), a *Rhizobium* protein (e.g. *Rhizobium* sp. NGR234 or *Rhizobium* eth), a *Mesorhizobium* protein (e.g. *Mesorhizobium loti*), a *Rickettsia* protein (e.g., a *R. prowazekii* protein or a *R. typhi* protein); an *Ensifer* protein (e.g., an *E. adhaerens* protein), and/or an *Ochrobactrum* protein (e.g., *Ochrobactrum haywardense*). In some embodiments, the bacterial transfer protein is a bacterial protein in a type IV secretion system. The bacterial transfer protein of the fusion protein may have any suitable length. In some embodiments, the bacterial transfer protein of the fusion protein has a length of 5, 10, 15, or 20 amino acids to 25, 30, 35, 40, 45, or 50 amino acids. In some embodiments, the bacterial transfer protein of the fusion protein has a length of 10, 25, 50, 75, 100, or 150 amino acids to 175, 200, 225, 250, 275, 300, 325, 350, or 375 amino acids. In some embodiments, the bacterial transfer protein comprises all or a portion of a binding domain (e.g., a peptide/protein binding domain or DNA binding domain) and/or a nuclear localization signal (e.g., a T4SS secretion signal). In some embodiments, the bacterial transfer protein comprises an amino acid sequence having at least 70%, 75%, 80%, 85%, or 90% amino acid sequence similarity to SEQ ID NOs:166, 167, 168, 225, and/or 226, optionally wherein the bacterial transfer protein comprises or is an amino acid sequence of SEQ ID NOs:166, 167, 168, 225, and/or 226. The bacterial transfer protein may comprise (e.g., all or a portion of) VirD2, VirE2, VirF, VirE3, VirD5, GALLS, MobA, MobC-CloDF13, TraI-F, TraI-RP4, TraIR388, CagA-Cag, and/or RalF-Dot/Icm. In some embodiments, the bacterial transfer protein comprises an *Agrobacterium* effector protein such as an *Agrobacterium* virulence protein (e.g., VirD2, VirE2, VirF, VirE3, VirD5, etc.).

The nucleic acid binding polypeptide of the fusion protein may be fused to the N- or C-terminus of the bacterial transfer protein, optionally with a linker (e.g., a peptide linker) between the bacterial transfer protein and the nucleic acid binding polypeptide. In some embodiments, the nucleic acid binding polypeptide of the fusion protein may be fused within the bacterial transfer protein (e.g., in a loop region of the bacterial transfer protein), optionally with a linker (e.g., a peptide linker) between the bacterial transfer protein and the nucleic acid binding polypeptide. In some embodiments, the nucleic acid binding polypeptide comprises (e.g., all or a portion of) a CRISPR-Cas effector protein such as, but not limited to, a Type I CRISPR-Cas system, a Type II CRISPR-Cas system, a Type III CRISPR-Cas system, a Type IV CRISPR-Cas system and/or a Type V CRISPR-Cas system. In some embodiments, the nucleic acid binding polypeptide comprises (e.g., all or a portion of) Cas9. In some embodiments, the nucleic acid binding polypeptide comprises (e.g., all or a portion of) Cas12 (e.g., Cas12a).

A composition, system, kit or complex of the present invention may comprise a fusion protein including a bacterial transfer protein and a nucleic acid binding polypeptide. In some embodiments, the composition, system, kit or complex comprises a guide nucleic acid. The fusion protein and guide nucleic acid may be comprised in a complex. In some embodiments, the composition, system, kit or complex comprises a T-DNA, and the bacterial transfer protein of the fusion protein may interact with the T-DNA.

A method of the present invention may comprise contacting a target nucleic acid with a guide nucleic acid and a fusion protein including a bacterial transfer protein and a nucleic acid binding polypeptide optionally to modify a target nucleic acid. In some embodiments, contacting the target nucleic acid comprises using a composition, system, kit or complex comprising the fusion protein to contact the target nucleic acid. In some embodiments, the fusion protein and the guide nucleic acid form a complex or are comprised in a complex. In some embodiments, a method, composition, system, kit or complex of the present comprises a T-DNA (e.g., a T-DNA that is present in an *Agrobacterium* such as during the contacting step). When the T-DNA is present, the bacterial transfer protein of the fusion protein may interact with the T-DNA. In some embodiments, the method is devoid of T-DNA transfer. In some embodiments, the method of modifying the target nucleic acid does not require T-DNA transfer in order to induce modification and/or provide the modified target nucleic acid and/or the method comprises non-templated editing, PRIME editing and/or REDRAW of the target nucleic acid. The fusion protein and/or the guide nucleic acid may be expressed in *Agrobacterium* that is contacted to a cell to thereby modify a target nucleic acid present in the cell. In some embodiments, a nucleic acid (e.g., a plasmid and/or T-DNA) of the *Agrobacterium* encodes the fusion protein and/or the guide nucleic acid. Upon contact of the *Agrobacterium* with a cell (e.g., a plant cell) the fusion protein and/or the guide nucleic acid (each of which may optionally be in a complex and/or which may be expressed in the *Agrobacterium* and/or encoded in a nucleic acid of the *Agrobacterium*) may be transported (e.g., secreted) into the cell comprising the target nucleic acid to thereby contact and modify the target nucleic acid. In some embodiments, an *Agrobacterium* cell expresses and/or encodes (e.g., on a plasmid such as a tumor inducing plasmid) the fusion protein and/or comprises the guide nucleic acid (e.g., on the same or different plasmid than the fusion protein) and, upon contact of the *Agrobacterium* cell and another cell (e.g., a plant cell), the expressed fusion protein and/or guide nucleic acid are transported (e.g., secreted) into the cell comprising a target nucleic acid to thereby modify the target nucleic acid. In some embodiments, the guide nucleic acid is encoded in a nucleic acid, plasmid or T-DNA of the *Agrobacterium* cell. In some embodiments, an *Agrobacterium* cell expresses the fusion protein and/or comprises the guide nucleic acid and, upon contact of the *Agrobacterium* cell and another cell (e.g., a plant cell), the expressed fusion protein and/or guide nucleic acid are transported (e.g., secreted) into the cell comprising a target nucleic acid to thereby modify the target nucleic acid. In some embodiments, the fusion protein and/or the guide nucleic acid may be transported (e.g., secreted) via a Type IV secretion system into the cell.

Provided according to some embodiments is a fusion protein comprising a nucleic acid binding polypeptide and a recruiting motif (e.g., an affinity polypeptide, an RNA recruiting motif, or a peptide tag). Exemplary fusion proteins comprising a nucleic acid binding polypeptide and a recruiting motif include, but are not limited to, those of SEQ ID NOs:173, 174, 176, 179, 183, 185, 187, 189, 193, and/or 195. In some embodiments, the nucleic acid binding polypeptide comprises (e.g., all or a portion of) a CRISPR-Cas effector protein such as, but not limited to, a Type I CRISPR-Cas system, a Type II CRISPR-Cas system, a Type III CRISPR-Cas system, a Type IV CRISPR-Cas system and/or a Type V CRISPR-Cas system. In some embodiments, the nucleic acid binding polypeptide comprises (e.g., all or a portion of) Cas9. In some embodiments, the nucleic acid binding polypeptide comprises (e.g., all or a portion of) Cas12 (e.g., Cas12a).

The recruiting motif of the fusion protein may be fused to the N- or C-terminus of the nucleic acid binding polypeptide, optionally with a linker (e.g., a peptide linker) between the nucleic acid binding polypeptide and the recruiting motif. In some embodiments, the recruiting motif of the fusion protein may be fused within the nucleic acid binding polypeptide (e.g., in a loop region of the nucleic acid binding polypeptide), optionally with a linker (e.g., a peptide linker) between the nucleic acid binding polypeptide and the recruiting motif. A corresponding motif for the recruiting motif may be used to recruit the fusion protein to a target (e.g., a bacterial transfer protein), a target site and/or a target nucleic acid. In some embodiments, the recruiting motif is an affinity polypeptide and optionally a peptide tag (e.g., a peptide tag fused to a bacterial transfer protein) that binds to the affinity polypeptide may be used to recruit the fusion protein to a target (e.g., the bacterial transfer protein), a target site, and/or a target nucleic acid. The recruiting motif may be an antibody that binds to the bacterial transfer protein, such as, but not limited to an antibody have an amino acid sequence of SEQ ID NO:169. In some embodiments, the recruiting motif is a peptide tag and optionally an affinity polypeptide (e.g., an affinity polypeptide fused to a bacterial transfer protein) that binds to the peptide tag may be used to recruit the fusion protein to a target (e.g., the bacterial transfer protein), a target site and/or a target nucleic acid. In some embodiments, the recruiting motif is an affinity polypeptide and optionally a RNA recruiting motif (e.g., a RNA recruiting motif fused to a guide nucleic acid) that binds to the affinity polypeptide may be used to recruit the fusion protein to a target (e.g., the guide nucleic acid), a target site and/or a target nucleic acid.

A composition, system, kit or complex of the present invention may comprise a fusion protein including a nucleic acid binding polypeptide and a recruiting motif. In some embodiments, the composition, system, kit or complex comprises a guide nucleic acid which may comprise a corresponding motif for the recruiting motif. In some embodiments, the composition, system, kit or complex comprises a bacterial transfer protein, which may comprise a corresponding motif for the recruiting motif. The bacterial transfer protein may comprise (e.g., all or a portion of) an *Agrobacterium* protein (e.g., an *Agrobacterium tumefaciens* protein or an *Agrobacterium rhizogenes* protein), a *Helicobacter pylori* protein, an *Enterococcus* protein (e.g., an *Enterococcus faecalis* protein), an *Escherichia coli* protein, a *Legionella* protein (e.g., a *L. pneumophila* protein), a *Sinorhizobium* protein (e.g. *Sinorhizobium meliloti*), a *Rhizobium* protein (e.g. *Rhizobium* sp. NGR234 or Rhizobium eth), a *Mesorhizobium* protein (e.g. *Mesorhizobium loti*), a *Rickettsia* protein (e.g., a *R. prowazekii* protein or a *R. typhi* protein); an *Ensifer* protein (e.g., an *E. adhaerens* protein), and/or an *Ochrobactum* protein (e.g., *Ochrobactrum haywardense*). In some embodiments, the bacterial transfer protein is a bacterial protein in a type IV secretion system. The bacterial transfer protein of the fusion protein may have any suitable length. In some embodiments, the bacterial transfer protein has a length of 5, 10, 15, or 20 amino acids to 25, 30, 35, 40, 45, or 50 amino acids. In some embodiments, the bacterial transfer protein of the fusion protein has a length of 10, 25, 50, 75, 100, or 150 amino acids to 175, 200, 225, 250, 275, 300, 325, 350, or 375 amino acids. In some embodiments, the bacterial transfer protein comprises all or a portion of a binding domain (e.g., a peptide/protein binding domain or DNA binding domain) and/or a nuclear localization signal (e.g., a T4SS secretion signal). In some embodiments, the bacterial transfer protein comprises an amino acid sequence having at least 70%, 75%, 80%, 85%, or 90% amino acid sequence similarity to SEQ ID NOs:166, 167, 168, 225, and/or 226, optionally wherein the bacterial transfer protein comprises or is an amino acid sequence of SEQ ID NOs:166, 167, 168, 225, and/or 226. The bacterial transfer protein may comprise (e.g., all or a portion of) VirD2, VirE2, VirF, VirE3, VirD5, GALLS, MobA, MobC-CloDF13, TraI-F, TraI-RP4, TraIR388, CagA-Cag, and/or RalF-Dot/Icm. In some embodiments, the bacterial transfer protein comprises an *Agrobacterium* effector protein such as an *Agrobacterium* virulence protein (e.g., VirD2, VirE2, VirF, VirE3, VirD5, etc.). In some embodiments, the composition, system, kit or complex comprises a T-DNA, and a bacterial transfer protein (that optionally interacts with the fusion protein) may interact with the T-DNA.

A method of the present invention may comprise contacting a target nucleic acid with a bacterial transfer protein, a guide nucleic acid, and a fusion protein including a nucleic acid binding polypeptide and a recruiting motif optionally to modify a target nucleic acid. In some embodiments, contacting the target nucleic acid comprises using a composition, system, kit or complex comprising the fusion protein to contact the target nucleic acid. In some embodiments, the fusion protein and the guide nucleic acid form a complex or are comprised in a complex. The complex may also comprise the bacterial transfer protein. In some embodiments, the guide nucleic acid comprises a corresponding motif (e.g., an RNA recruiting motif such as an RNA aptamer) for the recruiting motif of the fusion protein, and this corresponding motif may recruit the fusion protein to the guide nucleic acid and/or to the target nucleic acid. In some embodiments, the bacterial transfer protein comprises a corresponding motif for the recruiting motif of the fusion protein, and this corresponding motif may recruit the fusion protein to the bacterial transfer protein and/or to the target nucleic acid. In some embodiments, a method, composition, system, kit or complex of the present comprises a T-DNA (e.g., a T-DNA that is present in an *Agrobacterium* such as during the contacting step). When the T-DNA is present, a bacterial transfer protein may interact with the T-DNA. In some embodiments, the method is devoid of T-DNA transfer. In some embodiments, the method of modifying the target nucleic acid does not require T-DNA transfer in order to induce modification and/or provide the modified target nucleic acid and/or the method comprises non-templated editing, PRIME editing and/or REDRAW of the target nucleic acid. The fusion protein, the bacterial transfer protein, and/or the guide nucleic acid may be expressed in *Agrobacterium* that is contacted to a cell to thereby modify a target nucleic acid present in the cell. In some embodiments, a nucleic acid (e.g., a plasmid and/or T-DNA) of the *Agrobacterium* encodes the fusion protein, the bacterial transfer protein and/or the guide nucleic acid. Upon contact of the *Agrobacterium* with a cell (e.g., a plant cell) the fusion protein, the bacterial transfer protein, and/or the guide nucleic acid (each of which may optionally be in a complex and/or which may be expressed in the *Agrobacterium* and/or encoded in a nucleic acid of the *Agrobacterium*) may be transported (e.g., secreted) into the cell comprising the target nucleic acid to thereby contact and modify the target nucleic acid. In some embodiments, an *Agrobacterium* cell expresses and/or encodes (e.g., on a plasmid such as a tumor inducing plasmid) the fusion protein, expresses and/or encodes (e.g., on the same or a different plasmid than the fusion protein) the bacterial transfer protein, and/or comprises the guide nucleic acid (e.g., on the same or different plasmid than the fusion protein and/or bacterial transfer protein) and, upon contact of the *Agrobacterium* cell and another cell (e.g., a plant cell), the expressed fusion protein, expressed bacterial transfer protein, and/or guide nucleic acid are transported (e.g., secreted) into the cell comprising a target nucleic acid to thereby modify the target nucleic acid. In some embodiments, the guide nucleic acid is encoded in a nucleic acid, plasmid or T-DNA of the *Agrobacterium* cell. In some embodiments, an *Agrobacterium* cell expresses the fusion protein, expresses the bacterial transfer protein, and/or comprises the guide nucleic acid and, upon contact of the *Agrobacterium* cell and another cell (e.g., a plant cell), the expressed fusion protein, expressed nucleic acid binding polypeptide, and/or guide nucleic acid are transported (e.g., secreted) into the cell comprising a target nucleic acid to thereby modify the target nucleic acid. In some embodiments, the fusion protein, the bacterial transfer protein, and/or the guide nucleic acid may be transported (e.g., secreted) via a Type IV secretion system into the cell.

According to some embodiments, the present invention provides a composition comprising a domain fused to a peptide tag (e.g., an epitope, a peptide repeat unit) or an affinity polypeptide, wherein the domain is capable of interacting with a T-DNA sequence. In some embodiments, the affinity polypeptide is capable of binding a peptide tag and/or an RNA recruiting motif. In some embodiments, the peptide tag or RNA recruiting motif may be fused to a nucleic acid binding polypeptide, thereby recruiting the domain capable of interacting with a T-DNA sequence to the nucleic acid binding polypeptide and to a nucleic acid target site to which the nucleic acid binding polypeptide binds.

In some embodiments, a composition is provided that comprises a nucleic acid binding polypeptide fused to an affinity polypeptide, wherein the affinity polypeptide is capable of binding a domain that is capable of interacting with a T-DNA sequence, optionally wherein the affinity polypeptide is an antibody capable of binding an *Agrobacterium* effector protein.

In some embodiments, the present invention provides a composition comprising (a) a domain that is capable of interacting with a T-DNA sequence (e.g., an *Agrobacterium* effector protein) fused to: (i) a nucleic acid binding polypeptide; and/or (ii) a domain that is capable of interacting with a nucleic acid binding polypeptide (e.g., an affinity polypeptide (e.g., a polypeptide capable of binding a peptide tag)). In some embodiments, a polypeptide that is capable of interacting with (binding) a T-DNA is an *Agrobacterium* effector protein (e.g., VirD2, VirE2, and the like). In some embodiments, when the *Agrobacterium* effector protein is VirD2, the VirD2 may covalently link to the T-DNA at the 5' end of the T-DNA. In some embodiments, when the *Agrobacterium* effector protein is VirE2, the VirE2 stoichiometrically "coats", "complexes", and/or "associates" non-covalently with ssT-DNA.

In some embodiments, the present invention provides a composition comprising a nucleic acid binding protein fused to an affinity polypeptide, wherein the affinity polypeptide is capable of binding a domain that is capable of interacting with a T-DNA sequence. In some embodiments, a domain that is capable of interacting with a T-DNA sequence may be an *Agrobacterium* effector protein (e.g., VirD2, VirE2) and the affinity polypeptide is capable of binding the *Agrobacterium* effector protein.

In some embodiments, the compositions of the invention may further comprise one or more CRISPR guide nucleic acids. In some embodiments, a CRISPR guide nucleic acid of the invention may be linked to an RNA recruiting motif.

In some embodiments, the present invention provides a system, the system comprising:
(a) an *Agrobacterium* effector fusion protein comprising an *Agrobacterium* effector protein domain fused to a peptide tag;
(b) a CRISPR-Cas effector fusion protein comprising a CRISPR-Cas effector protein domain fused to an affinity polypeptide that is capable of interacting with the peptide tag;
(c) optionally a T-DNA sequence; and
(d) a CRISPR guide nucleic acid comprising a spacer sequence and a repeat sequence, wherein the guide nucleic acid is capable of forming a complex with the CRISPR-Cas effector protein domain of the CRISPR-Cas fusion protein and the spacer sequence is capable of hybridizing to a target nucleic acid, thereby guiding the CRISPR-Cas fusion protein to the target nucleic acid, wherein the affinity polypeptide of the CRISPR-Cas fusion protein interacts with the peptide tag of the *Agrobacterium* effector fusion protein and the *Agrobacterium* effector protein domain associates with the T-DNA (if present), thereby recruiting the *Agrobacterium* effector protein domain and optionally the T-DNA to the CRISPR-Cas effector protein domain and to the target nucleic acid, whereby the system is capable of modifying the target nucleic acid.

In some embodiments, the present invention provides a system, the system comprising:
(a) a CRISPR-Cas effector fusion protein comprising a CRISPR-Cas effector protein domain fused to a peptide tag;
(b) an *Agrobacterium* effector fusion protein comprising an *Agrobacterium* effector protein domain fused to an affinity polypeptide that is capable of interacting with the peptide tag;
(c) optionally a T-DNA sequence; and
(d) a CRISPR guide nucleic acid comprising a spacer sequence and a repeat sequence, wherein the guide nucleic acid is capable of forming a complex with the CRISPR-Cas effector protein domain of the CRISPR-Cas fusion protein and the spacer sequence is capable of hybridizing to a target nucleic acid, thereby guiding the CRISPR-Cas fusion protein to the target nucleic acid, wherein the peptide tag of the CRISPR-Cas fusion protein interacts with the affinity polypeptide of the *Agrobacterium* effector fusion protein and optionally the *Agrobacterium* effector protein domain associates with (covalently links to, e.g., VirD2, non-covalently with, e.g., VirE2)) the T-DNA (if present), thereby recruiting the *Agrobacterium* effector protein domain and optionally the T-DNA to the CRISPR-Cas effector protein domain and to the target nucleic acid, whereby the system is capable of modifying the target nucleic acid.

In some embodiments, the present invention provides a system, the system comprising:
(a) an *Agrobacterium* effector protein domain;
(b) a CRISPR-Cas effector fusion protein comprising a CRISPR-Cas effector protein domain fused to an affinity polypeptide that is capable of interacting with the *Agrobacterium* effector protein domain (e.g., an antibody to the *Agrobacterium* effector domain);
(c) optionally a T-DNA sequence; and
(d) a CRISPR guide nucleic acid comprising a spacer sequence and a repeat sequence, wherein the guide nucleic acid is capable of forming a complex with the CRISPR-Cas effector protein domain of the CRISPR-Cas fusion protein and the spacer sequence is capable of hybridizing to a target nucleic acid, thereby guiding the CRISPR-Cas fusion protein to the target nucleic acid, wherein the affinity polypeptide of the CRISPR-Cas fusion protein interacts with the *Agrobacterium* effector protein domain and optionally the *Agrobacterium* effector protein domain associates with the T-DNA (if present), thereby recruiting the *Agrobacterium* effector protein domain and optionally the T-DNA to the CRISPR-Cas effector protein domain and to the target nucleic acid, whereby the system is capable of modifying the target nucleic acid.

In some embodiments, the polypeptides and/or polynucleotides of this invention may be delivered to a cell or target nucleic acid separately or in any combination. Two or more polynucleotides of the invention may be under the control of the same promoter (using, for example P2A peptides to separate the domains) or they may be under the control of different promoters. In some embodiments, a guide nucleic acid of this invention may be expressed in the same expression cassette as one or more of the polypeptides of the invention and/or under the same or a different promoter as any one of the polypeptides.

In some embodiments, a T-DNA (also referred to interchangeably as a T-DNA sequence) may be delivered on a T-DNA plasmid. When the T-DNA is delivered on plasmid, rather than via an *Agrobacterium* strain modified to carry the T-DNA, a VirD1 polypeptide/domain may also be introduced into and expressed in the cell, wherein the introduced VirD1 and VirD2 are capable of generating the T-DNA sequence from the plasmid. In some embodiments, a method and/or system of the present invention does not include delivering a T-DNA to a cell.

In some embodiments, a T-DNA sequence may be delivered via an engineered *Agrobacterium* strain modified to carry the T-DNA. In some embodiments, the same or a different *Agrobacterium* strain may be used to deliver a T-DNA than the strain used to deliver a bacterial transfer protein (e.g., an *Agrobacterium* effector protein (e.g., VirD2, VirE2)), a fusion protein as described herein, a nucleic acid binding polypeptide, and/or a guide nucleic. In some embodiments, an engineered *Agrobacterium* strain may be modified to comprise a fusion protein as described herein, a bacterial transfer protein, a nucleic acid binding polypeptide (e.g., a nucleic acid binding polypeptide such as a CRISPR-Cas effector protein) and/or a guide nucleic acid. In some embodiments, an engineered *Agrobacterium* strain comprises and/or expresses a fusion protein as described herein, a bacterial transfer protein, a nucleic acid binding polypeptide (e.g., a nucleic acid binding polypeptide such as a CRISPR-Cas effector protein) and/or a guide nucleic acid. In some embodiments, an engineered *Agrobacterium* strain may be modified to comprise a fusion protein as described herein, a bacterial transfer protein, a nucleic acid binding polypeptide (e.g., a nucleic acid binding polypeptide such as a CRISPR-Cas effector protein), a guide nucleic acid, and/or a T-DNA (e.g., a T-DNA comprising an edit and/or repair template) on the same or different T-DNA sequences each other.

In some embodiments, one or more of the polypeptides, one or more of the polynucleotides, one or more of the expression cassettes, and/or one or more of the vectors of the invention may be comprised in one or more engineered

*Agrobacterium* strains for delivering to a cell. In some embodiments, two or more (e.g., 2, 3, 4, or more) different engineered *Agrobacterium* strains are used in a composition, system, and/or method of the present invention. For example, a first engineered *Agrobacterium* strain may express and/or encode a fusion protein as described herein and a second engineered *Agrobacterium* strain may comprise a guide nucleic acid and/or express and/or encode a nucleic acid binding protein. An engineered *Agrobacterium* strain may comprise, express, and/or encode a fusion protein as described herein, a nucleic acid binding protein, and/or a bacterial transfer protein and/or comprise a guide nucleic acid. In some embodiments, an engineered *Agrobacterium* strain may encode a fusion protein as described herein, a nucleic acid binding protein, and/or a bacterial transfer protein and/or comprise a guide nucleic acid on the same plasmid (e.g., a tumor-inducing plasmid or another plasmid) or different plasmids. For example, a tumor-inducing plasmid of an *Agrobacterium* cell may comprise a guide nucleic acid and optionally a T-DNA and a separate plasmid of the *Agrobacterium* cell may encode for a fusion protein, a nucleic acid binding protein, and/or a bacterial transfer protein, optionally wherein the fusion protein, nucleic acid binding protein, and/or bacterial transfer protein are expressed in the *Agrobacterium* cell. In some embodiments, a fusion protein as described herein, a nucleic acid binding protein, a bacterial transfer protein, and/or a guide nucleic acid are present in an *Agrobacterium* cell and optionally one or more is present in the form of a complex (e.g., a ribonucleoprotein complex). An engineered *Agrobacterium* strain may be devoid of and/or have knocked out a wild-type bacterial transfer protein (e.g., a wild-type *Agrobacterium* virulence protein). For example, an engineered *Agrobacterium* strain may have VirD2 knocked out. In some embodiments, an engineered *Agrobacterium* strain may be a disarmed *Agrobacterium* strain. A "disarmed *Agrobacterium* strain" as used herein refers to an *Agrobacterium* strain that has been modified compared to its native sequence and/or structure so that introduction of a polypeptide and/or polynucleotide from the strain into a plant cell cannot cause and/or provide the hairy root and/or tumor phenotype in the plant cell.

In some embodiments, the present invention provides an engineered *Agrobacterium* strain comprising a bacterial transfer protein (e.g., an *Agrobacterium* effector protein sequence) fused to a recruiting motif (e.g., an affinity polypeptide or a peptide tag). In some embodiments, a bacterial transfer protein is an *Agrobacterium* effector protein such as an *Agrobacterium* virulence protein. In some embodiments, the *Agrobacterium* virulence protein may be a virD2 polypeptide or domain thereof, or a virE2 polypeptide or domain thereof.

In some embodiments, a nucleic acid binding polypeptide (e.g., a sequence-specific DNA binding protein such as a CRISPR-Cas effector protein) and a guide nucleic acid may be delivered as a preassembled ribonucleoprotein (RNP). In some embodiments, a guide nucleic acid and a fusion protein comprising a nucleic acid binding polypeptide (e.g., a sequence-specific DNA binding protein such as a CRISPR-Cas effector protein) may be delivered as a preassembled RNP. In some embodiments, a nucleic acid binding polypeptide (e.g., a sequence-specific DNA binding protein such as a CRISPR-Cas effector protein), a fusion protein of the present invention, a bacterial transfer protein, T-DNA and/or a guide nucleic acid may be delivered using an engineered *Agrobacterium* strain optionally carrying expression cassettes encoding one or more of the nucleic acid binding polypeptide, fusion protein of the present invention, bacterial transfer protein, T-DNA and/or guide nucleic acid.

The invention further provides methods for modifying a target nucleic acid, the methods comprising contacting a target nucleic acid or a cell comprising the target nucleic acid (when using *Agrobacterium* for delivery) with a fusion protein, composition, system, or complex of the invention. The methods may be carried out in an in vivo system (e.g., in a cell or in an organism) or in an in vitro system (e.g., cell free).

In some embodiments, a method of modifying a target nucleic acid comprises contacting the target nucleic acid with a composition of the invention capable of interacting with (binding) the target nucleic acid in a sequence specific manner, thereby modifying the target nucleic acid. In some embodiments, the method comprises recruiting to the target nucleic acid at least one T-DNA sequence comprising a nucleic acid sequence to be edited into the target nucleic acid (e.g., a template such as a repair template).

In some embodiments, the present invention provides a method of modifying a target nucleic acid in a plant, the method comprising contacting a target nucleic acid with (a) a domain that is capable of interacting with a T-DNA sequence (e.g., an *Agrobacterium* effector protein), (b) (i) a nucleic acid binding polypeptide or (ii) a domain that is capable of interacting with the nucleic acid binding polypeptide (e.g., an affinity polypeptide (e.g., a polypeptide capable of binding a peptide tag)), and (c) optionally a T-DNA sequence.

In some embodiments, the methods of the invention further comprise contacting a target nucleic acid with a CRISPR guide nucleic acid (e.g., crRNA, crDNA). In some embodiments, a CRISPR guide nucleic acid of the invention may be linked to an RNA recruiting motif.

In some embodiments, a method of modifying a target nucleic acid is provided, the method comprising contacting the target nucleic acid with: (a) a nucleic acid binding polypeptide; (b) a DNA-dependent DNA polymerase; (c) optionally a T-DNA sequence comprising a primer binding site with complementarity to the sequence of a nicked target DNA strand; and (d) optionally a guide nucleic acid (e.g., CRISPR RNA, CRISPR DNA, crRNA, crDNA), thereby modifying the target nucleic acid. In some embodiments, the primer binding site may be located on the 3' end of the T-DNA sequence. In some embodiments, the primer binding site may be at least about 90% complementarity to the target nucleic acid. In some embodiments, the guide nucleic acid may be linked to an RNA recruiting motif and the DNA-dependent DNA polymerase may be fused to an affinity polypeptide that is capable of binding the RNA recruiting motif.

In some embodiments, a method of the invention may comprise contacting a target nucleic acid with a CRISPR-Cas effector protein and a guide nucleic acid, wherein the CRISPR-Cas effector protein is a nickase (e.g., nCas9, nCas12a) that nicks and/or that is configured to nick a (first) site on the first strand of the target nucleic acid that is located about 10 to about 125 base pairs (either 5' or 3') from a site on the second strand that has been nicked by the Type V CRISPR-Cas effector protein, thereby improving mismatch repair, wherein the CRISPR-Cas effector protein is a Type I, Type II, Type III, Type IV, or Type V CRISPR-Cas effector protein.

In some embodiments, the invention provides a method of modifying a target nucleic acid, the method comprising: contacting the target nucleic acid at a first target site with (a)(i) a first CRISPR-Cas effector protein; and (ii) a first T-DNA sequence; and (b)(i) a second CRISPR-Cas effector protein, (ii) a DNA-dependent DNA polymerase; and (ii) a first guide nucleic acid, thereby modifying the target nucleic acid. In some embodiments, the CRISPR nucleic acid of the first guide nucleic acid may comprise a spacer sequence that binds to a second site on the first strand of the target nucleic acid that is upstream of the first site on the second strand of the target nucleic acid. In some embodiments, the T-DNA may be recruited to the target nucleic acid as described herein.

In some embodiments, the methods of the invention may further comprise contacting the target nucleic acid with (a) a third CRISPR-Cas effector protein; and (b) a second guide nucleic acid, wherein the third CRISPR-Cas effector protein nicks a site on the first strand of the target nucleic acid that is located about 10 to about 125 base pairs (either 5' or 3') from a second site on the second strand that has been nicked by the second CRISPR-Cas effector protein, thereby improving mismatch repair.

In some embodiments, the methods of the invention may further comprise contacting the target nucleic acid with (a) a fourth CRISPR-Cas effector protein; (b) a second DNA-dependent DNA polymerase, and (c) a second T-DNA sequence, wherein the second T-DNA sequence is designed to target a site on the first strand of the target nucleic acid, thereby modifying the target nucleic acid.

A first guide nucleic acid of the invention may comprise a CRISPR nucleic acid (CRISPR RNA, CRISPR DNA, crRNA, crDNA). In some embodiments, the CRISPR nucleic acid of the first guide nucleic acid may comprises a spacer sequence that binds to a second site on the first strand of the target nucleic acid that is upstream of the first site on the second strand of the target nucleic acid.

In some embodiments, a second CRISPR-Cas effector protein may be a CRISPR-Cas fusion protein comprising a CRISPR-Cas effector protein domain fused to a DNA-dependent DNA polymerase. In some embodiments, a second CRISPR-Cas effector protein may be a CRISPR-Cas fusion protein comprising a CRISPR-Cas effector protein domain fused to a peptide tag and the DNA-dependent DNA polymerase is a DNA-dependent DNA polymerase fusion protein comprising a DNA-dependent DNA polymerase domain fused to an affinity polypeptide capable of binding the peptide tag.

In some embodiments, a first guide nucleic acid may be linked to an RNA recruiting motif and the DNA-dependent DNA polymerase may be a DNA-dependent DNA polymerase fusion protein comprising a DNA-dependent DNA polymerase domain fused to an affinity polypeptide capable of binding the RNA recruiting motif.

In some embodiments, a method of the invention may comprise contacting a target nucleic acid with a 5'-3' exonuclease. In some embodiments, the 5'-3' exonuclease may be fused to a CRISPR-Cas effector protein (e.g., a first CRISPR-Cas effector protein). In some embodiments, the 5'-3' exonuclease may be a fusion protein comprising the 5'-3' exonuclease fused to a peptide tag and a CRISPR-Cas effector protein may be fused to an affinity polypeptide that is capable of binding to the peptide tag. In some embodiments, a 5'-3' exonuclease may be a fusion protein comprising the 5'-3' exonuclease fused to an affinity polypeptide that is capable of binding to the peptide tag and a CRISPR-Cas effector protein may be fused to a peptide tag. In some embodiments, a 5'-3' exonuclease may be a fusion protein comprising the 5'-3' exonuclease fused to an affinity polypeptide that is capable of binding to an RNA recruiting motif and a guide nucleic acid may be linked to the RNA recruiting motif.

In some embodiments, a method of the present invention comprises reducing double strand breaks by introducing a chemical inhibitor of non-homologous end joining (NHEJ), by introducing a CRISPR guide nucleic acid and/or an siRNA targeting an NHEJ protein to transiently knock-down expression of the NHEJ protein, and/or by introducing a polypeptide that prevents NHEJ (e.g., a Gam protein).

In some embodiments, a first CRISPR-Cas effector protein, a second CRISPR-Cas effector protein, a third CRISPR-Cas effector protein and/or a fourth CRISPR-Cas effector protein may be a Type I, Type II, Type III, Type IV, or Type V CRISPR-Cas effector protein, in any combination.

In some embodiments, a domain that is capable of interacting with a T-DNA sequence may be an *Agrobacterium* effector protein. In some embodiments, an *Agrobacterium* effector protein comprises an *Agrobacterium* polypeptide that is capable of being used to recruit a T-DNA to a target site as described herein. In some embodiments, an *Agrobacterium* effector protein may be an *Agrobacterium* virulence polypeptide or domain thereof. In some embodiments, an *Agrobacterium* effector protein may be a VirD2 polypeptide or domain thereof. In some embodiments, an *Agrobacterium* effector protein may be aVirE2 polypeptide or domain thereof.

In some embodiments, an *Agrobacterium* effector protein may be an *Agrobacterium* effector fusion protein. In some embodiments, an *Agrobacterium* effector fusion protein may comprise an *Agrobacterium* effector protein domain fused/associated with (a) a nucleic acid binding polypeptide (e.g., a sequence-specific DNA binding domain (e.g., a CRISPR-Cas effector protein, a zinc finger effector protein, and/or a transcription activator-like effector (TALE) protein)), or (b) a domain capable of interacting with the nucleic acid binding polypeptide (e.g., a recruiting RNA motif; an affinity polypeptide). In some embodiments, a nucleic acid binding polypeptide or a domain capable of interacting with the s nucleic acid binding polypeptide may be fused/associated with the N-terminus or C-terminus of an *Agrobacterium* effector protein. In some embodiments, a nucleic acid binding polypeptide or a domain capable of interacting with a nucleic acid binding polypeptide may be incorporated within the primary sequence of the *Agrobacterium* effector protein.

In some embodiments of the invention, a nucleic acid binding polypeptide may be a CRISPR-Cas effector protein, zinc finger effector protein, meganuclease, and/or a transcription activator-like effector (TALE) protein, optionally wherein the nucleic acid binding polypeptide maybe a fusion protein.

In some embodiments, a nucleic acid binding polypeptide may be a CRISPR-Cas effector protein, optionally wherein the CRISPR-Cas effector protein may be from a Type I CRISPR-Cas system, a Type II CRISPR-Cas system, a Type III CRISPR-Cas system, a Type IV CRISPR-Cas system, Type V CRISPR-Cas system, or a Type VI CRISPR-Cas system. In some embodiments, a CRISPR-Cas effector protein of the invention may be from a Type II CRISPR-Cas system or a Type V CRISPR-Cas system. In some embodiments, a CRISPR-Cas effector protein may be Type II CRISPR-Cas effector protein, for example, a Cas9 effector protein. In some embodiments, a CRISPR-Cas effector protein may be Type V CRISPR-Cas effector protein, for example, a Cas12 effector protein.

CRISPR-Cas effector proteins for editing are commonly engineered to comprise a nuclear localization signal (NLS)

on the C-terminus and/or the N-terminus. In some embodiments, a CRISPR-Cas effector protein may be present and/or expressed at a relatively high concentration in a target cell relative to a complex comprising a T-DNA sequence and an *Agrobacterium* effector protein (e.g., VirD2/T-DNA complex, VirE2/T-DNA complex). In order to avoid competition between the T-DNA sequence/*Agrobacterium* effector protein complex and free CRISPR-Cas effector protein for target binding in the nucleus of a cell, an NLS-lacking CRISPR protein may be expressed and/or provided in the plant cells instead of a CRISPR-Cas effector protein with an engineered NLS. In some embodiments, a NLS-lacking CRISPR-Cas effector proteins may be engineered with an affinity polypeptide (e.g., a scFv antibody domain) against a specified epitope (e.g., a peptide tag) that will be fused to the *Agrobacterium* effector protein (e.g., VirD2, VirE2). NLS-lacking CRISPR-Cas effector proteins may be retained in the cytoplasm until non-covalently recruited to VirD2 through antibody/epitope interaction. After which they may be transported into the nucleus with VirD2 through the nuclear pore system, using the NLS signal of VirD2.

In addition to strategies that utilize non-covalently recruitment, VirD2:Cpf1 and VirE2:Cpf1 fusions may be used for co-delivery of a T-DNA complex and Cpf1 into a plant cell. This strategy may have the advantage that it bypasses the step of VirD2 and VirE2 antibody fusions to find the Cpf1:epitope counterpart. Therefore, it may promote the translocation of the T-DNA complex to specific genomic site.

Stoichiometry of proteins within a plant nucleus may play a role in the recruitment of a fusion protein, bacterial transfer protein, and/or CRISPR-Cas effector protein to target nucleic acid. For example, stoichiometry of proteins within the plant nucleus may play a role in the recruitment of a VirD2/VirE2 T-DNA complex by a CRISPR-Cas effector protein to specific genomic sites. One strategy to promote a 1:1 ratio of VirD2 or VirE2 proteins and Cpf1 in the nucleus may be the recruitment of Cpf1:epitope by VirD2:antibody or VirE2:antibody in the plant cytosol. To achieve this, a Cpf1:epitope fusion lacking a nuclear localization signal (NLS) can be recruited by either VirD2:antibody or VirE2:antibody in the cytosol and can be co-imported into the nucleus. In some embodiments, plant cells can be transformed by *Agrobacterium* carrying the modified VirD2 or VirE2 antibody, recruitment domain or epitope fusions. An expression cassette encoding the Cpf1:antibody, recruitment domain or epitope fusion lacking the NLS sequence may be delivered together with a guide cassette into the plant nucleus on the T-DNA. The expression cassette can include a visual marker, e.g. ZsGreen that can be co delivered on the T-DNA to assist in identifying successful transformations. The successful import of Cpf1 into the plant nucleus can be verified by molecular screening for editing at the Cpf1 target site in the plant genome.

In some embodiments, an antibody:VirD2:A3A fusion, a Cpf1:epitope and a crRNA cassette targeting a known CRISPR base editing site may be co-expressed in human cells. Detection of base editing activity in the DNA at that target demonstrates recruitment of Vir proteins.

In some embodiments, a T-DNA/VirD2 or VirE2 associated complex may be recruited to a specific genomic site with CRISPR proteins. In this strategy, T-DNA production comprises a DNA molecule with left and right border sequences and the virulence proteins VirD1 and VirD2. Heterologous production of T-DNA complexes has been achieved in *E. coli* and plant cells and in vitro using these components. T-DNA complexes manufactured in vitro have been shown to locate to the nuclease of human cells. On this basis, T-DNA complex recruitment could be tested heterologously in human or plant cells by co-expressing VirD1, VirD2 fused to a recruitment domain, and optionally, VirE2, and simultaneously delivering a DNA molecule containing the left and right border sequences.

In some embodiments, a nucleic acid binding polypeptide may be a zinc finger effector protein. In some embodiments, a nucleic acid binding polypeptide may be a meganuclease. In some embodiments, a nucleic acid binding polypeptide may be a transcription activator-like effector (TALE) protein. In some embodiments, a nucleic acid binding polypeptide may be an argonaute protein.

In some embodiments, a nucleic acid binding polypeptide may be a sequence-specific DNA binding fusion protein. In some embodiments of the invention, a sequence-specific DNA binding fusion protein may comprise a nucleic acid binding polypeptide fused to a peptide tag or to an affinity polypeptide, optionally wherein the affinity polypeptide is capable of interacting with (e.g., binding) a peptide tag or a domain that is capable of interacting with a T-DNA sequence (e.g., the affinity polypeptide may be, for example, an antibody capable of binding an *Agrobacterium* effector protein). In some embodiments, a domain that is capable of interacting with a nucleic acid binding polypeptide may be a peptide tag or an affinity polypeptide, optionally wherein the affinity polypeptide is capable of interacting with (e.g., binding) a peptide tag or with an RNA recruiting motif.

In some embodiments, a sequence-specific DNA binding fusion protein may be a CRISPR-Cas effector fusion protein that comprises a CRISPR-Cas effector domain fused to an *Agrobacterium* effector protein/domain.

In some embodiments, an *Agrobacterium* effector protein may be an *Agrobacterium* effector fusion protein. In some embodiments, an *Agrobacterium* effector fusion protein may comprise an *Agrobacterium* effector protein domain fused to a peptide tag and/or an *Agrobacterium* effector protein domain fused to an affinity polypeptide that is capable of binding a peptide tag. In some embodiments, an *Agrobacterium* effector fusion protein may comprise an *Agrobacterium* effector protein domain fused to a peptide tag and a sequence-specific DNA binding fusion protein may be a CRISPR-Cas effector fusion protein that comprises a CRISPR-Cas effector domain fused to an affinity polypeptide, which affinity polypeptide is capable of binding the peptide tag, wherein the CRISPR-Cas effector fusion protein is capable binding to the target nucleic acid, and the *Agrobacterium* effector protein is recruited to the target nucleic acid by the association of the peptide tag with the affinity polypeptide (optionally thereby recruiting any T-DNA associated with the *Agrobacterium* effector protein to the target nucleic acid). In some embodiments, a sequence-specific DNA binding fusion protein may be a CRISPR-Cas effector fusion protein that comprises an CRISPR-Cas effector protein domain fused to a peptide tag and a *Agrobacterium* effector fusion protein may comprise an *Agrobacterium* effector protein domain fused to an affinity polypeptide that is capable of binding the peptide tag, wherein the CRISPR-Cas effector fusion protein is capable binding to the target nucleic acid and the *Agrobacterium* effector protein is recruited to the target nucleic acid by the association of the peptide tag with the affinity polypeptide (optionally thereby recruiting any T-DNA associated with the *Agrobacterium* effector protein to the target nucleic acid).

In some embodiments, the invention provides a CRISPR guide nucleic acid linked to an RNA recruiting motif and an *Agrobacterium* effector fusion protein that comprises an Agrobacterium effector protein domain fused to an affinity polypeptide that is capable of binding the RNA recruiting motif, optionally wherein the RNA recruiting motif is linked to the 5' end or to the 3' end of the CRISPR nucleic acid, wherein the RNA recruiting motif of the CRISPR guide nucleic acid is capable of recruiting the Agrobacterium effector fusion protein to a target nucleic acid to which the CRISPR-Cas guide nucleic acid is capable of binding (optionally thereby recruiting any T-DNA associated with the Agrobacterium effector protein to the target nucleic acid).

In some embodiments, the invention provides a T-DNA sequence for introducing a modification or edit. In some embodiments, a T-DNA of the invention may have a length of about 400 nucleotides to about 30,000 nucleotides (e.g., about 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 20,500, 21,000, 21,500, 22,000, 22,500, 23,000, 23,500, 24,000, 24,500, 25,000, 25,500, 26,000, 26,500, 27,000, 27,500, 28,000, 28,500, 29,000, 29,500, 30,000 nucleotides or more in length, or any value or range therein). Thus, in some embodiments, a T-DNA of this invention may be about 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000 nucleotides to about 1100, 1200, 1300, 1400, 1500, 1600, 1700, 1800, 1900, 2000, 2500, 3000, 3500, 4000, 4500, 5000, 5500, 6000, 6500, 7000, 7500, 8000, 8500, 9000, 9500, or 10,000 nucleotides or more in length, or any value or range therein, or about 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, or 700 nucleotides to about 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, 1100, 1200, 1300, 1400, 1500, 1600, 1700, 1800, 1900, 2000, 2500, 3000, 3500, 4000, 4500, or 5000 nucleotides or more in length, or any value or range therein. In some embodiments, a T-DNA of this invention may be about 1000, 1100, 1200, 1300, 1400, 1500, 1600, 1700, 1800, 1900, 2000, 2500, 3000, 3500, 4000, 4500, 5000, 5500, 6000, 6500, 7000, 7500, 8000, 8500, 9000, 9500, or 10,000 nucleotides to about 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 20,500, 21,000, 21,500, 22,000, 22,500, 23,000, 23,500, 24,000, 24,500, 25,000, 25,500, 26,000, 26,500, 27,000, 27,500, 28,000, 28,500, 29,000, 29,500, or 30,000 nucleotides or more in length, or any value or range therein or about.

In some embodiments, a T-DNA that is useful with the methods of this invention may be a single stranded sequence (ssT-DNA) or it may be a double stranded sequence (dsT-DNA).

In some embodiments, a T-DNA sequence may comprise a 3' homology region (e.g., 3' homology arm) and/or 5' homology region (e.g., 5' homology arm), wherein the 3' homology region and/or 5' homology region may comprise sequence complementarity to a target nucleic acid (e.g., a target site). In some embodiments, a T-DNA sequence may comprise a 3' homology region (e.g., arm) having homology to the target nucleic acid but no 5' homology arm. In some embodiments, the length of a 3' homology region and/or a 5' homology region may be about 4 nucleotides to about 1000 nucleotides (e.g., about 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, or any value or range therein), optionally about 30 nucleotides to about 1000 nucleotides in length (e.g., about 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides in length, or any value or range therein). Thus, in some embodiments, the length of a 3' homology region and/or a 5' homology region of a T-DNA of this invention may be about 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, or 400 nucleotides to about 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 nucleotides, and any range or value therein; about 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides to about 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, or 600 nucleotides, and any range or value therein; or about 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nucleotides to about 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, or 750 nucleotides, and any range or value therein.

In some embodiments, the complementarity of a 3' homology region and/or a 5' homology region of a T-DNA to a target nucleic acid may be at least about 80% (e.g., about 80, 81, 82, 83, 84, 85, 86, 87, 88, 89, 90, 91, 92, 93, 94, 95, 96, 97, 98, 99, 99.5, 99.6, 99.7, 99.8, 99.9, or 100% complementarity, or any value or range therein) across about 4 to about 1000 consecutive nucleotides as described herein. In some embodiments, complementarity of the 3' homology region and/or 5' homology region to a target nucleic acid may be about 85% to about 100%, about 90% to about 100%, about 95% to 100%, about 96% to about 100%, about 97% to about 100%, about 98% to about 100%, about 99% to about 100%, or at least about 99.5%, 99.6%, 99.7%, 99.8%, or 99.9%.

In some embodiments, a T-DNA sequence of the invention may comprise an edit for incorporation into the target nucleic acid located in the 5' direction relative to the 3' homology region, and in the 3' direction relative to the 5' homology region, when a 5' homology arm is present.

In some embodiments of the invention, a T-DNA may comprise a primer binding site having complementarity to the 3' end of a nick in a genomic target site. This embodiment is somewhat like a template for prime editing, wherein the nicked target strand primes the T-DNA as a template and a DNA-dependent DNA polymerase incorporates the T-DNA sequence into the target. In this configuration, homology regions may be present or may not be present. The DNA-dependent DNA polymerase could be endogenous, or could be transgenic (introduced) and be generally overexpressed in the host cell.

In some embodiments, a primer binding site on a T-DNA sequence may comprise a length of about 4 to about 30 nucleotides or more (e.g., about 4, 5, 6, 7, 8, 9, 10, 11, 12, 13, 14, 15, 16, 17, 18, 19, 20, 21, 22, 23, 24, 25, 26, 27, 28, 29, 30 nucleotides or more, or any range or value therein). A primer binding site useful with a T-DNA sequence of this invention may be a nucleotide sequence having sufficient complementarity to a target nucleic acid such that it can bind to the target nucleic acid (e.g., about 90% to about 100% complementarity to a target nucleic acid; e.g., about 90, 91, 92, 93, 94, 95, 96, 97, 98, 99, 99.5, 99.6, 99.7, 99.8, 99.9, or 100% complementarity, or any value or range therein). Thus, a primer binding site on a T-DNA as described herein can act as a primer to a nicked genomic strand (e.g., nicked by a sequence specific DNA binding domain comprising nickase activity) of a target nucleic acid, thereby bringing an edit located on the T-DNA sequence within proximity of the target nucleic acid for use with a DNA-dependent polymerase and nucleic acid binding polypeptide for incorporating the edit into the target nucleic acid.

In some embodiments, a T-DNA sequence may comprise an edit for incorporation into a target nucleic acid, the edit being located in the 5' direction relative to the primer binding site of the T-DNA.

In some embodiments, a T-DNA sequence of this invention may comprise a 3' microhomologous sequence and a 5' microhomologous sequence, wherein the 3' microhomologous sequence and the 5' microhomologous sequence have a length of about 3 consecutive nucleotides to about 30 consecutive nucleotides having complementarity to the target nucleic acid (e.g., about 3, 4, 5, 6, 7, 8, 9, 10, 11, 12, 13, 14, 15, 16, 17, 18, 19, 20, 21, 22, 23, 24, 25, 26, 27, 28, 29, 30 nucleotides in length or any range or value therein; optionally about 4 nucleotides to about 30 nucleotides in length, or about 3 nucleotides to about 25 nucleotides in length or any range or value therein). In some embodiments, a 3' microhomologous sequence and a 5' microhomologous sequence may have complementarity to a sequence in the target nucleic acid (e.g., about 90% to about 100% complementarity to a target nucleic acid; e.g., about 90, 91, 92, 93, 94, 95, 96, 97, 98, 99, 99.5, 99.6, 99.7, 99.8, 99.9, or 100% complementarity, or any value or range therein) across about 3 to about 30 consecutive nucleotides. In some embodiments, a T-DNA sequence of this invention comprising a 3' microhomologous sequence and a 5' microhomologous sequence may comprise an edit for incorporation into the target locus located in the 5' direction relative to the 3' microhomologous sequence and in the 3' direction relative to the 5' microhomologous sequence.

In some embodiments of the invention, a T-DNA sequence may be configured to integrate via non-homologous end-joining (NHEJ). In some embodiments, a T-DNA sequence for integration via NHEJ does not comprise a 3' homology region or a 5' homology region. In some embodiments, a T-DNA sequence for use in NHEJ may comprise a 3' microhomologous sequence and a 5' microhomologous sequence as described herein.

In some embodiments, a guide nucleic acid may be linked to an RNA recruiting motif, and a polypeptide to be recruited to the guide nucleic acid (and to a target nucleic acid) may be a fusion protein that is fused (linked) to an affinity polypeptide, which is capable of binding the RNA recruiting motif that is linked to the guide. For example, a guide nucleic acid may be linked to an RNA recruiting motif, and a DNA dependent DNA polymerase may be a fusion protein comprising a DNA dependent DNA polymerase domain fused (linked) to an affinity polypeptide that binds to the RNA recruiting motif, optionally wherein the target nucleic acid is contacted with two or more DNA dependent DNA polymerase fusion proteins. As another example, a CRISPR guide nucleic acid may be fused to an RNA recruiting motif and an *Agrobacterium* effector fusion protein comprising an *Agrobacterium* effector protein domain may be fused to an affinity polypeptide that is capable of binding the RNA recruiting motif, wherein the CRISPR guide is capable of interacting with the *Agrobacterium* effector fusion protein, thereby the CRISPR guide nucleic acid recruits the *Agrobacterium* effector fusion protein to the target site that the CRISPR guide nucleic acid is capable of binding (through its complementary spacer sequence).

In some embodiments of the invention, a guide RNA may be linked to one or to two or more RNA recruiting motifs (e.g., 1, 2, 3, 4, 5, 6, 7, 8, 9, 10 or more motifs; e.g., at least 10 to about 25 motifs), optionally wherein the two or more RNA recruiting motifs may be the same RNA recruiting motif or different RNA recruiting motifs.

In some embodiments, a peptide tag useful with this invention can include, but is not limited to, a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope. In some embodiments, the peptide tag may be a GCN4 peptide tag. In some embodiments, a peptide tag may comprise two or more copies of the peptide tag (e.g., a peptide repeat; e.g., two or more tandem copies; e.g., tandem copies of GCN4).

In some embodiments, an affinity polypeptide can include, but is not limited to, an antibody, optionally a scFv antibody that is capable of binding a peptide tag (e.g., a GCN4 peptide tag, a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope).

In some embodiments, an RNA recruiting motif may be linked to the 5' end or to the 3' end of the CRISPR nucleic acid to provide a recruiting crRNA/recruiting crDNA. In some embodiments, an RNA recruiting motif and its corresponding affinity polypeptide (e.g., affinity polypeptide that is capable of binding the RNA recruiting motif) can include, but is not limited to, a telomerase Ku binding motif (e.g., Ku binding hairpin) and the affinity polypeptide of Ku (e.g., Ku heterodimer); a telomerase Sm7 binding motif and the affinity polypeptide of Sm7; an MS2 phage operator stem-loop and the affinity polypeptide MS2 Coat Protein (MCP), a PP7 phage operator stem-loop and the affinity polypeptide PP7 Coat Protein (PCP); an SfMu phage Com stem-loop and the affinity polypeptide Com RNA binding protein; a PUF binding site (PBS) and the affinity polypeptide Pumilio/fem-3 mRNA binding factor (PUF); and/or a synthetic RNA-aptamer and the corresponding aptamer ligand. In some embodiments, the RNA recruiting motif and its corresponding affinity polypeptide may be an MS2 phage operator stem-loop and the affinity polypeptide MS2 Coat Protein (MCP), and/or a PUF binding site (PBS) and the affinity polypeptide Pumilio/fem-3 mRNA binding factor (PUF).

In some embodiments, the polypeptides of the invention (e.g., a domain that is capable of interacting with a T-DNA sequence, a nucleic acid binding polypeptide, a domain that is capable of interacting with the nucleic acid binding polypeptide, a CRISPR-Cas effector protein, a zinc finger effector protein, a transcription activator-like effector (TALE) protein, a CRISPR-Cas effector fusion protein/domain, a *Agrobacterium* effector protein, a *Agrobacterium* fusion protein, a peptide tag, and/or an affinity polypeptide) may be encoded by one or more polynucleotides. In some embodiments, the one or more polynucleotides may be comprised in one or more expression cassettes and/or one or more vectors. Thus, a domain that is capable of interacting with a T-DNA sequence may be encoded by a polynucleotide, a nucleic acid binding polypeptide may be encoded by a polynucleotide, a domain that is capable of interacting with the nucleic acid binding polypeptide may be encoded by a polynucleotide, a CRISPR-Cas effector protein may be encoded by a polynucleotide, a zinc finger effector protein may be encoded by a polynucleotide, a transcription activator-like effector (TALE) protein may be encoded by a polynucleotide, a CRISPR-Cas effector fusion protein/domain may be encoded by a polynucleotide, a *Agrobacterium* effector protein may be encoded by a polynucleotide, a *Agrobacterium* fusion protein may be encoded by a polynucleotide, a peptide tag may be encoded by a polynucleotide, and/or an affinity polypeptide may be encoded by a polynucleotide.

In some embodiments, a polynucleotide encoding a domain that is capable of interacting with a T-DNA sequence, a polynucleotide encoding a nucleic acid binding polypeptide, a polynucleotide encoding a domain that is capable of interacting with the nucleic acid binding polypeptide, a polynucleotide encoding a CRISPR-Cas effector protein, a polynucleotide encoding the zinc finger effector protein, a polynucleotide encoding a TALE protein, a polynucleotide encoding a CRISPR-Cas effector fusion protein/domain, a polynucleotide encoding an *Agrobacterium* effector protein, a polynucleotide encoding an *Agrobacterium* effector fusion protein, a polynucleotide encoding a peptide tag, a polynucleotide encoding an affinity polypeptide, a polynucleotide comprising T-DNA sequence, and/or a polynucleotide comprising a guide nucleic acid may be comprised in one or more expression cassettes. In some embodiments, the polypeptides and nucleic acids of the invention may be encoded by/comprised in one or more polynucleotides and the one or more polynucleotides may be comprised in the same or separate expression cassettes in any combination. In some embodiments, when comprised in a single expression cassette, the polynucleotides may be operably linked to a single promoter or to any combination of separate promoters.

An expression cassette of the present invention may be comprised in one or more vectors to be delivered to an organism and/or a cell, for example, an animal (e.g., a mammal, an insect, a fish, and the like), a plant (e.g., a dicot plant, a monocot plant), a bacterium, an archaeon, and the like).

In some embodiments, a polynucleotide, expression cassette and/or vector of the invention may be codon optimized for expression in an organism (e.g., an animal, a plant, a bacterium, an archaeon, and the like). In some embodiments, the polynucleotides, expression cassettes, and/or vectors may be codon optimized for expression in a plant, optionally a dicot plant or a monocot plant.

In some embodiments, the polynucleotides, nucleic acid constructs, expression cassettes or vectors of the invention that are optimized for expression in an organism (e.g., a plant) may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the polynucleotides, nucleic acid constructs, expression cassettes or vectors encoding the same but which have not been codon optimized for expression in the organism (e.g., the plant).

The nucleic acid constructs of the invention and/or guide nucleic acids may be comprised in one or more expression cassettes as described herein. In some embodiments, a nucleic acid construct of the invention may be comprised in the same or in a separate expression cassette or vector from that comprising a guide nucleic acid.

As described herein, the nucleic acids of the invention and/or expression cassettes and/or vectors comprising the same may be codon optimized for expression in an organism. An organism useful with this invention may be any organism or cell thereof for which nucleic acid modification may be useful. An organism can include, but is not limited to, any animal, any plant, any fungus, any archaeon, or any bacterium. In some embodiments, the organism may be a plant or cell thereof.

In some embodiments, an expression cassette of the invention may be codon optimized for expression in a dicot plant or it may be codon optimized for expression in a monocot plant. In some embodiments, the expression cassettes of the invention may be used in a method of modifying a target nucleic acid in a plant or plant cell, the method comprising introducing one or more expression cassettes of the invention into the plant or plant cell, thereby modifying the target nucleic acid in the plant or plant cell to produce a plant or plant cell comprising the modified target nucleic acid. In some embodiments, an expression cassette and/or vector of the invention may be introduced via an engineered *Agrobacterium* comprising one or more of the polynucleotides, expression cassettes and/or vectors of the invention. In some embodiments, the method may further comprise regenerating the plant cell that comprises the modified target nucleic acid to produce a plant comprising the modified target nucleic acid.

In some embodiments, the nucleic acid constructs, expression cassettes or vectors of the invention that are optimized for expression in a plant may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the nucleic acid constructs, expression cassettes or vectors comprising the same polynucleotide(s) but which have not been codon optimized for expression in a plant.

A target nucleic acid of any plant or plant part may be modified using the nucleic acid constructs of the invention. Any plant (or groupings of plants, for example, into a genus or higher order classification) may be modified using a polypeptide and/or polynucleotide of the present invention including an angiosperm, a gymnosperm, a monocot, a dicot, a C3, C4, CAM plant, a bryophyte, a fern and/or fern ally, a microalgae, and/or a macroalgae. A plant and/or plant part useful with this invention may be a plant and/or plant part of any plant species/variety/cultivar. The term "plant part," as used herein, includes but is not limited to, embryos, pollen, ovules, seeds, leaves, stems, shoots, flowers, branches, fruit, kernels, ears, cobs, husks, stalks, roots, root tips, anthers, plant cells including plant cells that are intact in plants and/or parts of plants, plant protoplasts, plant tissues, plant cell tissue cultures, plant calli, plant clumps, and the like. As used herein, "shoot" refers to the above ground parts including the leaves and stems. Further, as used herein, "plant cell" refers to a structural and physiological unit of the plant, which comprises a cell wall and also may refer to a protoplast. A plant cell can be in the form of an isolated single cell or can be a cultured cell or can be a part of a higher-organized unit such as, for example, a plant tissue or a plant organ.

In some embodiments, when a plant part or plant cell is stably transformed, it can then be used to regenerate a stably transformed plant comprising one or more modifications as described herein using the compositions and methods of the invention.

Non-limiting examples of plants useful with the present invention include turf grasses (e.g., bluegrass, bentgrass, ryegrass, fescue), feather reed grass, tufted hair grass, miscanthus, arundo, switchgrass, vegetable crops, including artichokes, kohlrabi, arugula, leeks, asparagus, lettuce (e.g., head, leaf, romaine), malanga, melons (e.g., muskmelon, watermelon, crenshaw, honeydew, cantaloupe), cole crops (e.g., brussels sprouts, cabbage, cauliflower, broccoli, collards, kale, chinese cabbage, bok choy), cardoni, carrots, napa, okra, onions, celery, parsley, chick peas, parsnips, chicory, peppers, potatoes, cucurbits (e.g., marrow, cucumber, zucchini, squash, pumpkin, honeydew melon, watermelon, cantaloupe), radishes, dry bulb onions, rutabaga, eggplant, salsify, escarole, shallots, endive, garlic, spinach, green onions, squash, greens, beet (sugar beet and fodder beet), sweet potatoes, chard, horseradish, tomatoes, turnips, and spices; a fruit crop such as apples, apricots, cherries, nectarines, peaches, pears, plums, prunes, cherry, quince, fig, nuts (e.g., chestnuts, pecans, pistachios, hazelnuts, pistachios, peanuts, walnuts, macadamia nuts, almonds, and the like), citrus (e.g., clementine, kumquat, orange, grapefruit, tangerine, mandarin, lemon, lime, and the like), blueberries, black raspberries, boysenberries, cranberries, currants, gooseberries, loganberries, raspberries, strawberries, blackberries, grapes (wine and table), avocados, bananas, kiwi, persimmons, pomegranate, pineapple, tropical fruits, pomes, melon, mango, papaya, and lychee, a field crop plant such as clover, alfalfa, timothy, evening primrose, meadow foam, corn/maize (field, sweet, popcorn), hops, jojoba, buckwheat, safflower, quinoa, wheat, rice, barley, rye, millet, sorghum, oats, triticale, sorghum, tobacco, kapok, a leguminous plant (beans (e.g., green and dried), lentils, peas, soybeans), an oil plant (rape, canola, mustard, poppy, olive, sunflower, coconut, castor oil plant, cocoa bean, groundnut, oil palm), duckweed, *Arabidopsis*, a fiber plant (cotton, flax, hemp, jute), *Cannabis* (e.g., *Cannabis sativa*, *Cannabis indica*, and *Cannabis ruderalis*), lauraceae (cinnamon, camphor), or a plant such as coffee, sugar cane, tea, and natural rubber plants; and/or a bedding plant such as a flowering plant, a cactus, a succulent and/or an ornamental plant (e.g., roses, tulips, violets), as well as trees such as forest trees (broadleaved trees and evergreens, such as conifers; e.g., elm, ash, oak, maple, fir, spruce, cedar, pine, birch, cypress, *eucalyptus*, willow), as well as shrubs and other nursery stock. In some embodiments, the nucleic acid constructs of the invention and/or expression cassettes and/or vectors encoding the same may be used to modify maize, soybean, wheat, canola, rice, cotton, tomato, pepper, sunflower, raspberry, blackberry, black raspberry and/or cherry.

In some embodiments, the invention provides cells (e.g., plant cells, animal cells, bacterial cells, archaeon cells, and the like) comprising one or more polynucleotides, guide nucleic acids, nucleic acid constructs, expression cassettes or vectors of the invention.

The present invention further comprises a kit or kits to carry out the methods of this invention. A kit of this invention can comprise reagents, buffers, and apparatus for mixing, measuring, sorting, labeling, etc., as well as instructions and the like as would be appropriate for modifying a target nucleic acid.

In some embodiments, the invention provides a kit comprising one or more and/or polypeptides of the invention and/or one or more polynucleotides of the invention (nucleic acid constructs) and/or expression cassettes and/or vectors comprising the same, with optional instructions for the use thereof. In some embodiments, a kit may comprise a CRISPR-Cas guide nucleic acid (corresponding to a CRISPR-Cas effector protein of the invention) and/or expression cassettes and/or vectors comprising the same. In some embodiments, a guide nucleic acid may be provided on the same expression cassette and/or vector as one or more nucleic acid constructs of the invention. In some embodiments, the guide nucleic acid may be provided on a separate expression cassette or vector from that comprising the one or more nucleic acid constructs of the invention.

In some embodiments, kits are provided comprising a nucleic acid construct comprising (a) a polynucleotide(s) as provided herein and (b) a promoter that drives expression of the polynucleotide(s) of (a). In some embodiments, the kit may further comprise a nucleic acid construct encoding a guide nucleic acid, wherein the construct comprises a cloning site for cloning of a nucleic acid sequence identical or complementary to a target nucleic acid sequence into backbone of the guide nucleic acid.

In some embodiments, a nucleic acid construct of the invention may be an mRNA that may encode one or more introns within the encoded polynucleotide(s). In some embodiments, the nucleic acid constructs of the invention and/or an expression cassettes and/or vectors comprising the same, may further encode one or more selectable markers useful for identifying transformants (e.g., a nucleic acid encoding an antibiotic resistance gene, herbicide resistance gene, and the like).

Embodiments of the present invention may be further described by the below clauses.

Clause 1. A composition comprising a domain fused to a recruiting motif (e.g., an affinity polypeptide or a peptide tag), wherein the domain is capable of interacting with a T-DNA sequence.

Clause 2. A composition comprising a nucleic acid binding polypeptide (e.g., a sequence-specific DNA binding domain) fused to a recruiting motif (e.g., an affinity polypeptide or a peptide tag), wherein the recruiting motif is capable of binding a domain that is capable of interacting with a T-DNA sequence (e.g., the recruiting motif may bind to the same or a different portion of the domain than the portion of the domain that interacts with the T-DNA sequence).

Clause 3. A composition comprising a domain that is capable of interacting with a T-DNA sequence fused to:
  (i) a nucleic acid binding polypeptide (e.g., a sequence-specific DNA binding domain); and/or
  (ii) a domain that is capable of interacting with a nucleic acid binding polypeptide (e.g., an affinity polypeptide (e.g., a polypeptide capable of binding a peptide tag)).

Clause 4. A composition comprising a nucleic acid binding polypeptide (e.g., a sequence-specific DNA binding domain) fused to an affinity polypeptide, wherein the affinity polypeptide is capable of binding a domain that is capable of interacting with a T-DNA sequence, optionally wherein the affinity polypeptide is an antibody capable of binding an *Agrobacterium* effector protein.

Clause 5. The composition of any one of clauses 1 to 4, further comprising a CRISPR guide nucleic acid.

Clause 6. The composition of any one of the preceding clauses, wherein the domain that is capable of interacting with a T-DNA sequence is an *Agrobacterium* effector protein.

Clause 7. The composition of clause 6, wherein the *Agrobacterium* effector protein is an *Agrobacterium* effector fusion protein.

Clause 8. The composition of clause 6 or clause 7, wherein the *Agrobacterium* effector protein is an *Agrobacterium* virulence polypeptide, optionally wherein the *Agrobacterium* virulence polypeptide is a polypeptide of virD2 and/or virE2.

Clause 9. The composition of any one of clauses 2 to 8, wherein the nucleic acid binding polypeptide is a CRISPR-Cas effector protein, zinc finger effector protein, meganuclease, and/or a transcription activator-like effector (TALE) protein, optionally wherein the nucleic acid binding polypeptide is a fusion protein.

Clause 10. The composition of any one of clauses 2 to 9, wherein the nucleic acid binding polypeptide is a CRISPR-Cas effector protein, optionally wherein the CRISPR-Cas effector protein does not comprise a nuclear localization signal (NLS).

Clause 11. The composition of clause 10, wherein the CRISPR-Cas effector protein is from a Type I CRISPR-Cas system, a Type II CRISPR-Cas system, a Type III CRISPR-Cas system, a Type IV CRISPR-Cas system or a Type V CRISPR-Cas system.

Clause 12. The composition clause 10 or clause 11, wherein the CRISPR-Cas effector protein is from a Type II CRISPR-Cas system or a Type V CRISPR-Cas system.

Clause 13. The composition of any one of clauses 10 to 12, wherein the CRISPR-Cas effector protein is a Cas9 effector protein or a Cas12 effector protein.

Clause 14. The composition of any one of clauses 10 to 13, wherein the CRISPR-Cas effector protein is a CRISPR-Cas effector fusion protein.

Clause 15. The composition of clause 14, wherein the CRISPR-Cas effector fusion protein comprises a CRISPR-Cas effector protein fused to an *Agrobacterium* effector protein.

Clause 16. The composition of any one of clauses 7 to 14, wherein the *Agrobacterium* effector fusion protein comprises an *Agrobacterium* effector protein fused to a peptide tag and the CRISPR-Cas effector fusion protein comprises a CRISPR-Cas effector protein fused to an affinity polypeptide that is capable of binding the peptide tag.

Clause 17. The composition of any one of clauses 7 to 14, wherein the CRISPR-Cas effector fusion protein comprises an CRISPR-Cas effector protein fused to a peptide tag and the *Agrobacterium* effector fusion protein comprises an *Agrobacterium* effector protein fused to an affinity polypeptide that is capable of binding the peptide tag.

Clause 18. The composition of any one of clauses 5 to 17, wherein the CRISPR guide nucleic acid is fused to an RNA recruiting motif and the *Agrobacterium* effector fusion protein comprises an *Agrobacterium* effector protein fused to an affinity polypeptide that is capable of binding the RNA recruiting motif.

Clause 19. The composition of any one of clauses 1 to 18, wherein the composition further comprises a T-DNA sequence.

Clause 20. The composition of clause 19, wherein the T-DNA sequence has a length of about 400 nucleotides to about 30,000 nucleotides.

Clause 21. The composition of clause 19 or clause 20, wherein the T-DNA sequence is a single stranded sequence (ssT-DNA).

Clause 22. The composition of clause 19 or clause 20, wherein the T-DNA sequence is a double stranded sequence (dsT-DNA).

Clause 23. The composition of any one of clauses 19 to 22, wherein the T-DNA sequence comprises a 5' homology region (e.g., homology arm) and/or 3' homology region having sequence complementarity to a target nucleic acid (e.g., target site).

Clause 24. The composition of clause 23, wherein the 5' homology region and/or the 3' homology region of the T-DNA sequence has a length of about 4 nucleotides to about 1000 nucleotides.

Clause 25. The composition of clause 23 or clause 24, wherein the T-DNA sequence comprises an edit for incorporation into the target nucleic acid located in the 5' direction relative to the 3' homology region, and in the 3' direction relative to the 5' homology region, when present.

Clause 26. The composition of any one of clauses 19 to 22, wherein a primer binding site is located on the 3' end of the T-DNA sequence, optionally wherein the primer binding site has a length of about 4 to about 30 nucleotides or more.

Clause 27. The composition of clause 26, wherein the T-DNA sequence comprises an edit for incorporation into the target nucleic acid located in the 5' direction relative to the primer binding site.

Clause 28. The composition of any one of clauses 19 to 22, wherein the T-DNA sequence comprises a 3' microhomologous sequence and a 5' microhomologous sequence.

Clause 29. The composition of clause 28, wherein the 3' microhomologous sequence and the 5' microhomologous sequence each have a length of about 3 nucleotides to about 30 nucleotides having complementarity to the target nucleic acid.

Clause 30. The composition of clause 28 or clause 29, wherein the T-DNA sequence comprises an edit for incorporation into the target locus located in the 5' direction relative to the 3' microhomologous sequence and in the 3' direction relative to the 5' microhomologous sequence.

Clause 31. The composition of any one of clauses 19 to 22, wherein the T-DNA sequence is configured to integrate via non-homologous end-joining.

Clause 32. The composition of any one of clauses 2 to 32, wherein the peptide tag comprises a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope.

Clause 33. The composition of any one of clauses 2 to 31, wherein the peptide tag comprises a GCN4 peptide tag (e.g., Sun-Tag).

Clause 34. The composition of any one of clauses 2 to 33, wherein the peptide tag comprises two or more copies (e.g., two or more tandem copies) of the peptide tag.

Clause 35. The composition of any one of clauses 2 to 17 or 19 to 34, wherein the affinity polypeptide is an antibody, optionally a scFv antibody.

Clause 36. The composition of any one of clauses 18 to 35, wherein the RNA recruiting motif is linked to the 5' end or to the 3' end of the CRISPR nucleic acid (e.g., a recruiting crRNA, a recruiting crDNA).

Clause 37. The composition of any one of clauses 18 to 36, wherein the RNA recruiting motif and a corresponding affinity polypeptide are a telomerase Ku binding motif (e.g., Ku binding hairpin) and the affinity polypeptide of Ku (e.g., Ku heterodimer); a telomerase Sm7 binding motif and the affinity polypeptide of Sm7; an MS2 phage operator stem-loop and the affinity polypeptide MS2 Coat Protein (MCP), a PP7 phage operator stem-loop and the affinity polypeptide PP7 Coat Protein (PCP); an SfMu phage Com stem-loop and the affinity polypeptide Com RNA binding protein; a PUF binding site (PBS) and the affinity polypeptide Pumilio/fem-3 mRNA binding factor (PUF); and/or a synthetic RNA-aptamer and the corresponding aptamer ligand.

Clause 38. The composition of any one of clauses 18 to 37, wherein the RNA recruiting motif and corresponding affinity polypeptide are an MS2 phage operator stem-loop and the affinity polypeptide MS2 Coat Protein (MCP), and/or a PUF binding site (PBS) and the affinity polypeptide Pumilio/fem-3 mRNA binding factor (PUF).

Clause 39. The composition of any one of clauses 1 to 38, wherein the domain that is capable of interacting with a T-DNA sequence is encoded by a polynucleotide, the nucleic acid binding polypeptide is encoded by a polynucleotide, the domain that is capable of interacting with the nucleic acid binding polypeptide is encoded by a polynucleotide, the CRISPR-Cas effector protein is encoded by a polynucleotide, the zinc finger effector protein is encoded by a polynucleotide, the transcription activator-like effector (TALE) protein is encoded by a polynucleotide, the CRISPR-Cas effector fusion protein is encoded by a polynucleotide, the *Agrobacterium* effector protein is encoded by a polynucleotide, the *Agrobacterium* fusion protein is encoded by a polynucleotide, the peptide tag is encoded by a polynucleotide, and/or the affinity polypeptide is encoded by a polynucleotide.

Clause 40. The composition of clause 39, wherein the polynucleotide encoding the polynucleotide encoding the domain that is capable of interacting with a T-DNA sequence, the polynucleotide encoding the nucleic acid binding polypeptide, the polynucleotide encoding the domain that is capable of interacting with the nucleic acid binding polypeptide, the polynucleotide encoding the CRISPR-Cas effector protein, the polynucleotide encoding the zinc finger effector protein, the polynucleotide encoding the TALE protein, the polynucleotide encoding the CRISPR-Cas effector fusion protein, the polynucleotide encoding the *Agrobacterium* effector protein, the polynucleotide encoding the *Agrobacterium* fusion protein, the polynucleotide encoding the peptide tag, and/or the polynucleotide encoding the affinity polypeptide are comprised in one or more expression cassettes.

Clause 41. The composition of clause 39 or clause 40, wherein the polynucleotide encoding the domain that is capable of interacting with a T-DNA sequence, the polynucleotide encoding the nucleic acid binding polypeptide, the polynucleotide encoding the domain that is capable of interacting with the nucleic acid binding polypeptide, the polynucleotide encoding the CRISPR-Cas effector protein, the polynucleotide encoding the zinc finger effector protein, the polynucleotide encoding the TALE protein, the polynucleotide encoding the CRISPR-Cas effector fusion protein, the polynucleotide encoding the *Agrobacterium* effector protein, the polynucleotide encoding the *Agrobacterium* effector fusion protein, the polynucleotide encoding the peptide tag, and/or the polynucleotide encoding the affinity polypeptide are comprised in one or more expression cassettes, wherein when comprised in one expression cassette, the polynucleotides are operably linked to a single promoter or to any combination of separate promoters.

Clause 42. The composition of clause 40 or clause 41, wherein the one or more expression cassettes are comprised in one or more vectors.

Clause 43. The composition of any one of clauses 39 to 42, wherein the polynucleotides, the one or more expression cassettes and/or the one or more vectors are codon optimized for expression in a plant.

Clause 44. A method of modifying a target nucleic acid in a plant, comprising contacting the target nucleic acid with the composition of any one of the clauses 2 to 43, thereby recruiting to a target nucleic acid a T-DNA comprising a nucleic acid sequence to be edited into the target nucleic acid, optionally wherein the T-DNA comprises a template (e.g., a repair template) that is used in modifying the target nucleic acid.

Clause 45. The method of clause 44, wherein one or more of the polynucleotides, one or more of the expression cassettes, and/or one or more of the vectors are comprised in one or more engineered *Agrobacterium* cells.

Clause 49. The method of clause 45, wherein a cell comprising the target nucleic acid is contacted with the one or more engineered *Agrobacterium* cells.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

Example 1: Cas12a Recruitment by VirD2

Construct Design

Gene expression of modified and unmodified virD2 was either driven by the constitutive J23102 promoter (SEQ ID NO:77) fused to a 3' ribosomal binding site, or the ubiquitin 2 promoter from *Medicago truncatula* (SEQ ID NO:1), transcription was terminated by the T7 early terminator (T7TE) (SEQ ID NO:78). The virD2 coding sequence from *Agrobacterium tumefaciens* C58 Ti-plasmid was fused to optimized coding sequences for gene expression in *Agrobacterium tumefaciens*. For N-terminal fusions of binding domains to VirD2 included a BE4 linker sequence (SEQ ID NOs:75 and 76). C-terminal fusions to VirD2 were fused via short serine/glycine linkers between amino acid 373 and 374 of VirD2 (SEQ ID NOs: 78 and 79). Alternatively, binding domains were fused between the C-terminal end of VirD2 and a VirF C-terminus (SEQ ID NO:165) from the *A. tumefaciens* C58 Ti-plasmid. A VirD2 deficient *A. tumefaciens* strain was transformed with plasmid encoded vird2 expression cassettes and T-DNA encoding a plant optimized zsgreen and cas12a expression cassette as well as a Cas12a guide cassette regulated by a plant U6 promoter. The Cas12a spacer (SEQ ID NO:61) was designed to target the two gene copies of phytoene desaturase (pds) in *Nicotiona benthamiana*. The cas12a gene was designed without nuclear localization sequences to ensure a cytosolic localization of the protein within the plant cell after biosynthesis. The various Cas12a designs and plasmids are provided in Table 1.

into the plant cell nucleus. Fluorescent microscopy pictures were taken 10-11 days after infiltration.

To prove that Cas12a was secreted, genomic DNA was extracted from 50 mg fluorescent *N. benthamiana* leaf tissue using the Plant DNeasy Mini Kit (Qiagen) or the DNeasy 96 Plant Kit (Qiagen). Samples were analyzed by deep amplicon sequencing for insertions and deletions (INDELs) at the pds target site. INDEL frequency of recruited Cas12a is shown in FIG. 2.

Example 2: Simultaneous Delivery of Protein (Cas12a) and RNA (crRNA) into a Eukaryotic Cell (Yeast or Plant)

Construct Design

Plasmid pWISE3452 (SEQ ID NO:80) (containing an *agrobacterium* expression cassette for Cas12a::VirD2

TABLE 1

Cas12a Recruitment Treatments and Corresponding Plasmids

| Treatment | Delivered Plasmids |
|---|---|
| VirD2::scFV (SEQ ID NO: 170) + 8xGCN4::Cas12a (SEQ ID NO: 173) | pWISE3093 (SEQ ID NO: 160) + pWISE3121 (SEQ ID NO: 161) |
| VirD2::8xGCN4 (SEQ ID NO: 175) + scFV::Cas12a (SEQ ID NO: 174) | pWISE3092 (SEQ ID NO: 133) + pWISE3117 (SEQ ID NO: 162) |
| scFv::VirD2 (SEQ ID NO: 177) + Cas12a::8xGCN4 (SEQ ID NO: 176) | pWISE3098 (SEQ ID NO: 159) + pWISE3107 (SEQ ID NO: 163) |
| 8xGCN4::VirD2 (SEQ ID NO: 178) + Cas12a::scFV (SEQ ID NO: 179) | pWISE3097 (SEQ ID NO: 117) + pWISE3103 (SEQ ID NO: 123) |
| VirD2-ScFv-VirF (SEQ ID NO: 180) + 8xGCN4-Cas12a (SEQ ID NO: 173) | pWISE3093 (SEQ ID NO: 160) + pWISE3114 (SEQ ID NO: 164) |
| VirD2::8xGCN4::VirF (SEQ ID NO: 181) + scFv::Cas12a (SEQ ID NO: 174) | pWISE3092 (SEQ ID NO: 133) + pWISE3110 (SEQ ID NO: 79) |
| SH3dom::VirD2 (SEQ ID NO: 182) + Cas12a::4xSH3lig (SEQ ID NO: 183) | pWISE3096 (SEQ ID NO: 132) + pWISE3108 (SEQ ID NO: 82) |
| 4xSH3lig::VirD2 (SEQ ID NO: 184) + Cas12a::SH3dom (SEQ ID NO: 185) | pWISE3095 (SEQ ID NO: 116) + pWISE3109 (SEQ ID NO: 122) |
| VirD2::SH3dom (SEQ ID NO: 185) + 4xSH3lig::Cas12a (SEQ ID NO: 187) | pWISE3091 (SEQ ID NO: 115) + pWISE3122 (SEQ ID NO: 121) |
| VirD2::SH3lig (SEQ ID NO: 188) + SH3dom::Cas12a (SEQ ID NO: 189) | pWISE3090 (SEQ ID NO: 137) + pWISE3123 (SEQ ID NO: 136) |
| VirD2::SH3dom::VirF (SEQ ID NO: 190) + 4xSH3lig::Cas12a (SEQ ID NO: 187) | pWISE3091 (SEQ ID NO: 115) + pWISE3115 (SEQ ID NO: 120) |
| VirD2::4xSH3lig::VirF (SEQ ID NO: 191) + SH3dom::Cas12a (SEQ ID NO: 189) | pWISE3090 (SEQ ID NO: 137) + pWISE3116 (SEQ ID NO: 159) |
| C-intein::VirD2 (SEQ ID NO: 192) + Cas12a::N-intein (SEQ ID NO: 193) | pWISE3094 (SEQ ID NO: 131) + pWISE3106 (SEQ ID NO: 128) |
| VirD2::N-intein::VirF (SEQ ID NO: 194) + C-intein::Cas12a (SEQ ID NO: 195) | pWISE3089 (SEQ ID NO: 134) + pWISE3113 (SEQ ID NO: 130) |
| VirD2 (SEQ ID NO: 168) + ZsGreen Complementation Control | pWISE711 (SEQ ID NO: 124) + pWISE3030 (SEQ ID NO: 119) |
| Editing control | pWISE768 (SEQ ID NO: 118) + pWISE711 (SEQ ID NO: 124) |
| Cas12a-no NLS (SEQ ID NO: 196) + VirD2::SH3dom::VirF (SEQ ID NO: 190) | pWISE3115 (SEQ ID NO: 120) + pWISE3088 (SEQ ID NO: 135) |

Figure 1:
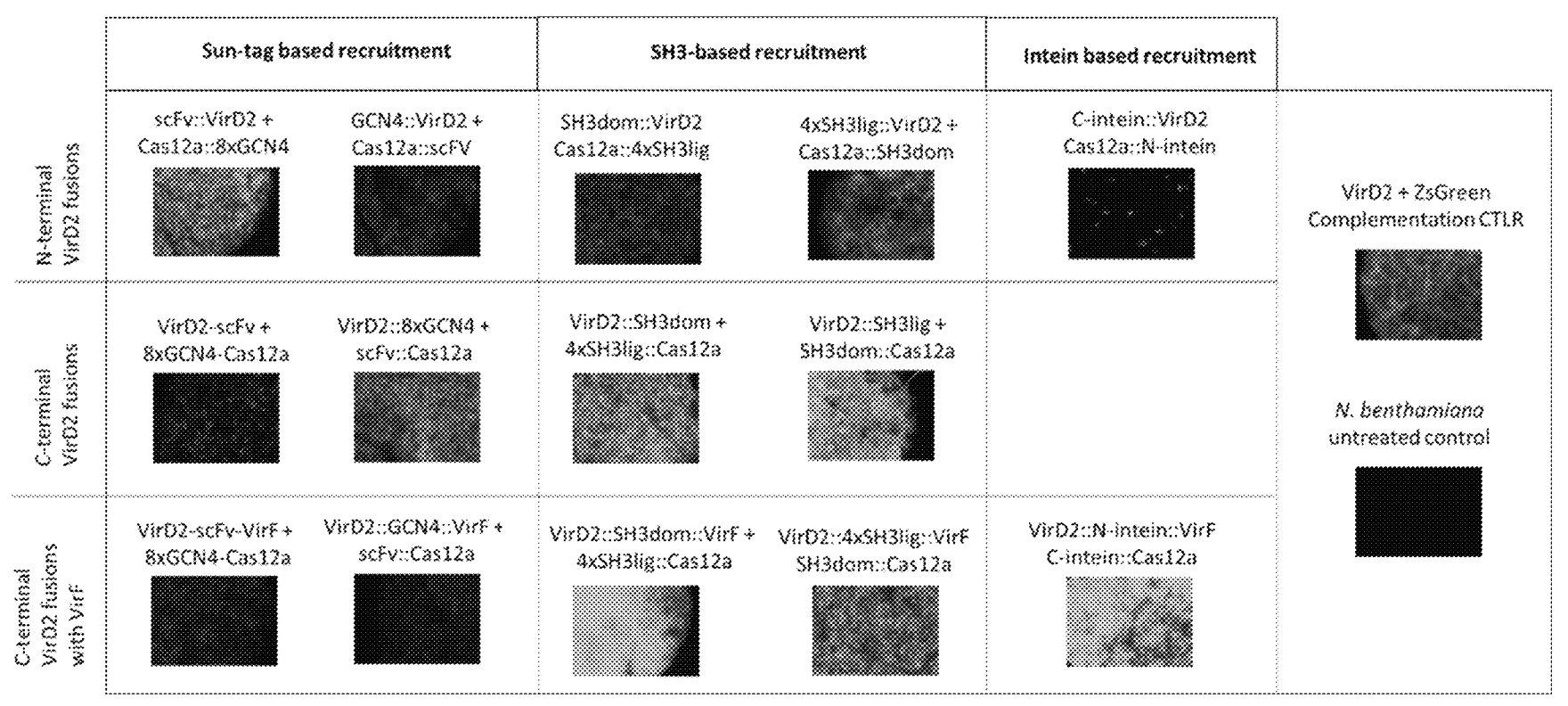
Figure 3:
FIG. 3 is a schematic of an *Agrobacterium* expression cassette for an exemplary LbCas12a crRNA according to some embodiments of the present invention.

Validation of VirD2 Functionality Through Delivery of a Zsgreen Encoding T-DNA to Plant Cell Nucleus Leaves of four-week-old *Nicotiana benthamiana* plants were infiltrated with *A. tumefaciens* overnight cultures (OD$_{600\ nm}$ of 0.7 in infiltration buffer: 10 mM MES, 10 mM MgCl$_2$, 100 uM acetosyringone, pH 5.6). Validation of VirD2 functionality by delivery of a zsgreen encoding T-DNA into the plant cells was done via fluorescent microscopy 10-11 days post infiltration (dpi). Green fluorescent leaves were sampled and gDNA was extracted for deep amplicon sequencing. FIG. 1 shows an example for successful T-DNA encoded zsgreen delivery by modified VirD2 driven by the VirB Operon promoter (SEQ ID NO:58)) or plasmid pWISE3111 (SEQ ID NO:125) (containing an *agrobacterium* expression cassette for VirD2::Cas12a::VirF driven by the synthetic BbaJ23102 promoter (SEQ ID NO:54) was used as the backbone for insertion of crRNA expression cassettes. An *agrobacterium* expression cassette is shown in FIG. 3, which was synthesized on the BioXP3250 and cloned into either pWISE3452 or pWISE3111 at the SmaI restriction site via Gibson assembly. Table 2 contains a description of the vectors used for the *Agrobacterium* RNP delivery experiments.

TABLE 2

Description of Vectors used in the *Agrobacterium* RNP Delivery Experiments.

| | pWISE | Editing Target | Spacer | RE Site | Cas12a Configuration | Parent Backbone | Purpose |
|---|---|---|---|---|---|---|---|
| 1 | pWISE3452 (SEQ ID NO: 80) | N/A | N/A | N/A | Cas12a::VirD2 (SEQ ID NO: 66) | N/A | Negative Control |
| 2 | pWISE3897 (SEQ ID NO: 143) | Yeast URA3 | PWsp1409 (SEQ ID NO: 0) | EcoRV | Cas12a::VirD2 (SEQ ID NO: 66) | pWISE3452 (SEQ ID NO: 80) | Test Vector |
| 3 | pWISE3898 (SEQ ID NO: 144) | Yeast URA3 | PWsp1410 (SEQ ID NO: 10) | NcoI | Cas12a::VirD2 (SEQ ID NO: 66) | pWISE3452 (SEQ ID NO: 80) | Test Vector |
| 4 | pWISE3899 (SEQ ID NO: 139) | Tobacco PDS | PWsp365 (SEQ ID NO: 11) | N/A | Cas12a::VirD2 (SEQ ID NO: 66) | pWISE3452 (SEQ ID NO: 80) | Test Vector |
| 5 | pWISE3900 (SEQ ID NO: 140) | Tobacco PDS | PWsp366 (SEQ ID NO: 12) | XhoI, SacI | Cas12a::VirD2 (SEQ ID NO: 66) | pWISE3452 (SEQ ID NO: 80) | Test Vector |
| 6 | pWISE3901 (SEQ ID NO: 145) | Yeast URA3 | PWsp1409 (SEQ ID NO: 59) | EcoRV | Cas12a::VirD2 (SEQ ID NO: 66) | pWISE3452 (SEQ ID NO: 80) | Test Vector |
| 7 | pWISE3902 (SEQ ID NO: 146) | Yeast URA3 | PWsp1410 (SEQ ID NO: 60) | NcoI | Cas12a::VirD2 (SEQ ID NO: 66) | pWISE3452 (SEQ ID NO: 80) | Test Vector |
| 8 | pWISE3111 (SEQ ID NO: 125) | N/A | N/A | N/A | VirD2::Cas12a::VirF (SEQ ID NO: 70) | N/A | Negative Control |
| 9 | pWISE3905 (SEQ ID NO: 147) | Yeast URA3 | PWsp1409 (SEQ ID NO: 59) | EcoRV | VirD2::Cas12a::VirF (SEQ ID NO: 70) | pWISE3111 (SEQ ID NO: 125) | Test Vector |
| 10 | pWISE3906 (SEQ ID NO: 148) | Yeast URA3 | PWsp1410 (SEQ ID NO: 60) | NcoI | VirD2::Cas12a::VirF (SEQ ID NO: 70) | pWISE3111 (SEQ ID NO: 125) | Test Vector |
| 11 | pWISE3910 (SEQ ID NO: 150) | Yeast URA3 | PWsp1409 (SEQ ID NO: 59) | EcoRV | VirD2::Cas12a::VirF (SEQ ID NO: 70) | pWISE3111 (SEQ ID NO: 125) | Test Vector |
| 12 | pWISE3911 (SEQ ID NO: 151) | Yeast URA3 | PWsp1410 (SEQ ID NO: 60) | NcoI | VirD2::Cas12a::VirF (SEQ ID NO: 70) | pWISE3111 (SEQ ID NO: 125) | Test Vector |
| 13 | pWISE711 (SEQ ID NO: 124) | ZsGreen Control | ZsGreen Control | N/A | N/A | N/A | Transformation Control |

Tobacco Leaf Infiltration Assay for Detecting Editing Via CRISPR/Cas Components Delivered as RNPs Via the Type IV Secretion System

*Agrobacterium tumefaciens* AB53ΔVirD2 was streaked out onto LB agar plates with gentamicin and grown at 28° C. for 48 hours. On the day of transformation, approximately half a loop's worth of *agrobacterium* was re-suspended in 1-mL of ultrapure water. The cells were then centrifuged and the supernatant discarded. The cells were washed an additional 2× with 1-mL of ultrapure water, re-suspended and aliquoted into 50 μL aliquots. The aliquots were chilled on ice and transformed with plasmid DNA immediately. Approximately 1 μg of DNA from each plasmid shown below in Table 3 was transformed into 50 μL of *A. tumefaciens* ΔVirD2 by electroporation. Transformations were plated onto LB agar plates containing kanamycin and gentamicin, and were grown at 28° C. for 48 hours.

TABLE 3

Plasmids Used in Rapid Tobacco Assays

| Plasmid | Spacer | Nuclease | Description |
|---|---|---|---|
| pWISE3111 (SEQ ID NO: 125) + pWISE711 (SEQ ID NO: 74) | N/A | VirD2::Cas12a::VirF (SEQ ID NO: 70) | Positive Control for Transformation |
| pWISE3111 (SEQ ID NO: 125) | N/A | VirD2::Cas12a::VirF (SEQ ID NO: 70) | Negative Control |
| pWISE3452 (SEQ ID NO: 80) | N/A | Cas12a::VirD2 (SEQ ID NO: 66) | Negative Control |
| pWISE3899 (SEQ ID NO: 139) | Tobacco PDS (PWsp365 SEQ ID NO: 61) | Cas12a::VirD2 (SEQ ID NO: 66) | Test Case |
| pWISE3900 (SEQ ID NO: 140) | Tobacco PDS (PWsp366 SEQ ID NO: 62) | Cas12a::VirD2 (SEQ ID NO: 66) | Test Case |

Leaves of 12 week old *Nicotiana benthamiana* plants were infiltrated with the *Agrobacterium* cultures harboring the appropriate vectors (3 leaves per construct) shown above in Table 3. The cultures were used at an $OD_{600\ nm}$ of 0.7 in infiltration buffer: 10 mM MES, 10 mM $MgCl_2$, 100 uM acetosyringone, pH 5.6). Once leaf infiltration was complete, the plants were grown in a growth chamber (22° C., 50% humidity with 8 hours light/16 hours dark) for 6 days. 2×50 mg of leaf tissue was then sampled from each plant using a hole punch, and genomic DNA was extracted using a DNeasy 96 plant kit (Qiagen) according to manufacturer's instructions. Samples were then analyzed by deep amplicon sequencing on an Illumina MiSeq to detect INDELS (insertions and deletions) at the PDS target site.

The spacers used in the tobacco experiments target the PDS locus. The predicted cut site for PWsp366 (SEQ ID NO:62) may result in the disruption of XhoI and SacI restriction sites, allowing for detection of editing by PCR amplification, restriction enzyme digestion and sanger sequencing. Therefore, in addition to the deep amplicon sequencing, the genomic DNA extracted from the tobacco leaf infiltrations with construct pWISE3900 (SEQ ID NO:140) and pWISE3452 (SEQ ID NO:80) were subjected to PCR amplification of a 1,000 bp fragment of the PDS locus with primers PM10269 (SEQ ID NO:152) and PM10270 (SEQ ID NO:153) and digestion with no enzyme, XhoI, or SacI to detect samples that had the restriction sites disrupted.

Rapid Tobacco Assay (AGROBEST) for Detecting Editing Via CRISPR/Cas Components Delivered as RNPs Via the Type IV Secretion System In addition to the tobacco leaf infiltration experiments, a modified version of the AGROBEST (Wu, Hung-Yi, et al. *Plant methods* 10.1 (2014): 19) system was also used. Tobacco seeds were first sterilized with 50% bleach and rinsed 5× with sterile water. 2 mL of ½ MS liquid medium (½ MS salt supplemented with 0.5% sucrose (w/v), pH 5.5 (adjusted to 5.7 by KOH but pH 5.5 after autoclaving) was added to each well of 6-well plates. In each well, approximately 6 *N. benthamiana* seeds were added. The lid was put onto the plate, and airpore tape was used to seal the edges of the plate. Seeds were then allowed to germinate at 22 C with 16-hr light and 8-hr dark cycle in a percival for 4 days.

Two days before co-cultivation, *Agrobacterium tumefaciens* AB53ΔVirD2 containing the constructs shown in Table 3 were inoculated in 5-mL LB liquid medium containing kanamycin and gentamicin and grown overnight at 28 C with 200 rpm shaking. The day prior to co-cultivation, the overnight *Agrobacterium* cultures were spun down at 5,000 rpm for 10 minutes in a bench-top centrifuge. The supernatant was discarded, and the cultures were re-suspended in induction medium (AB-MES with 200 μM acetosyringone, no antibiotics) to a final $OD_{600}$ of 0.2. Cultures were then returned to the incubator overnight at 28 C with 200 rpm shaking.

The following day, the *Agrobacterium* expression cultures were pelleted at 5,000 rpm for 10 minutes. The pellets were then re-suspended in co-cultivation liquid media (¼ MS, ½ AB-MES, acetosyringone 200 μM) to a final $OD_{600}$ of 0.12.

The growth medium of the tobacco seedlings was then replaced with the co-cultivation liquid media, and incubated for 48 hours in the percival in the same conditions as above. After the 48-hour co-cultivation, the tobacco seedlings were transferred into water to wash off any *Agrobacterium* on the surface of the plants. They were then transferred to new 6-well plates containing 2-mL of ½ MS+200 mg/L of Timentin. The seedlings were then returned to the percival and grown for 24 hours. The following day, all seedlings from each well were rinsed off with water and put into a 96-well block with 2 steel ball bearings for genomic DNA extraction. The samples were frozen at −80 C prior to DNA extraction. Genomic DNA was then extracted using a DNeasy 96 plant kit (Qiagen) according to manufacturer's instructions. Samples were then analyzed by deep amplicon sequencing on an Illumina MiSeq to detect INDELS (insertions and deletions) at the PDS target site.

The spacers used in the tobacco experiments target the PDS locus. The predicted cut site for PWsp366 (SEQ ID NO:62) may result in the disruption of XhoI and SacI restriction sites, allowing for detection of editing by PCR amplification, restriction enzyme digestion and sanger sequencing. Therefore, in addition to the deep amplicon sequencing, the genomic DNA extracted from the tobacco leaf infiltrations with construct pWISE3900 (SEQ ID NO:140) and pWISE3452 (SEQ ID NO:80) were subjected to PCR amplification of a 1,000 bp fragment of the PDS locus with primers PM10269 (SEQ ID NO:152) and PM10270 (SEQ ID NO:153) and digestion with no enzyme, XhoI, or SacI to detect samples that had the restriction sites disrupted.

Yeast Assay for Detecting Editing Via CRISPR/Cas Components Delivered as RNPs Via the Type IV Secretion System

*Agrobacterium tumefaciens* AB53ΔVirD2 was streaked out onto LB agar plates with gentamicin and grown at 28° C. for 48 hours. On the day of transformation, approximately half a loop's worth of *agrobacterium* was re-suspended in 1-mL of ultrapure water. The cells were then centrifuged and the supernatant discarded. The cells were washed an additional 2× with 1-mL of ultrapure water, re-suspended and aliquoted into 50 μL aliquots. The aliquots were chilled on ice and transformed with plasmid DNA immediately. Approximately 1 μg of DNA from each plasmid shown in Table 4 was transformed into 50 μL of *A. tumefaciens* ΔVirD2 by electroporation. Transformations were plated onto LB agar plates containing kanamycin and gentamicin, and were grown at 28° C. for 48 hours.

TABLE 4

Plasmids Used in Yeast Assay

| Plasmid | Spacer | Nuclease | Description |
|---|---|---|---|
| pWISE3111 (SEQ ID NO: 125) + pWISE711 (SEQ ID NO: 124) | N/A | VirD2::Cas12a::VirF (SEQ ID NO: 70) | Positive Control for Transformation |
| pWISE3111 (SEQ ID NO: 125) | N/A | VirD2::Cas12a::VirF (SEQ ID NO: 70) | Negative Control |
| pWISE3452 (SEQ ID NO: 80) | N/A | Cas12a::VirD2 (SEQ ID NO: 66) | Negative Control |
| pWISE3897 (SEQ ID NO: 143) | Yeast URA3 (PWsp1409 SEQ ID NO: 59) | Cas12a::VirD2 (SEQ ID NO: 66) | Test Case |
| pWISE3898 (SEQ ID NO: 144) | Yeast URA3 (PWsp1410 SEQ ID NO: 60) | Cas12a::VirD2 (SEQ ID NO: 66) | Test Case |
| pWISE3901 (SEQ ID NO: 145) | Yeast URA3 (PWsp1409 SEQ ID NO: 59) | Cas12a::VirD2 (SEQ ID NO: 66) | Test Case |
| pWISE3902 (SEQ ID NO: 146) | Yeast URA3 (PWsp1410 SEQ ID NO: 60) | Cas12a::VirD2 (SEQ ID NO: 66) | Test Case |
| pWISE3905 (SEQ ID NO: 147) | Yeast URA3 (PWsp1409 SEQ ID NO: 59) | VirD2::Cas12a::VirF (SEQ ID NO: 70) | Test Case |

TABLE 4-continued

Plasmids Used in Yeast Assay

| Plasmid | Spacer | Nuclease | Description |
|---|---|---|---|
| pWISE3906 (SEQ ID NO: 148) | Yeast URA3 (PWsp1410) SEQ ID NO: 60) | VirD2::Cas12a::VirF (SEQ ID NO: 70) | Test Case |
| pWISE3910 (SEQ ID NO: 150) | Yeast URA3 (PWsp1409) SEQ ID NO: 59) | VirD2::Cas12a::VirF (SEQ ID NO: 70) | Test Case |
| pWISE3911 (SEQ ID NO: 151) | Yeast URA3 (PWsp1410) SEQ ID NO: 60) | VirD2::Cas12a::VirF (SEQ ID NO: 70) | Test Case |

Three to four colonies from each *Agrobacterium* transformation plate were picked and inoculated into 5-mL LB liquid culture with kanamycin and gentamicin, and a colony of *S. cerevisiae* al was also inoculated into 10-mL of YPD liquid media in a 50-mL plastic bioreactor. Cultures were grown overnight at 28 C with shaking at 200 rpm. The following day, the *Agrobacterium* cultures were spun down at 5,000 rpm for 10 minutes in a table-top centrifuge. The supernatant was discarded, and the cultures were re-suspended in 5-mL of induction medium (IM: ½ MS salts and 40 mM MES, pH 5.3, 10 mM glucose, 0.5% (w/v) glycerol and 200 mM acetosyringone (AS)) to a final $OD_{600}$ of 0.25. Cultures were then incubated for an additional 5 hours at 28 C with 200 rpm shaking. The overnight yeast culture was pelleted, and re-suspended in 1-mL of IM liquid media.

Yeast and *Agrobacterium* cultures were then mixed 1:1 in a 96-well plate and incubated at 28 C with no shaking. At 84 +/−12 hours of incubation, the yeast and *Agrobacterium* cultures were plated on YPD (yeast extract, peptone, dextrose) agar plates with 0.2% 5-FOA, 500 mg/L carbenicillin and 200 mg/L cefotaxime. After two days of selection areas of stronger growth were examined with PCR. At 108+/−12 hours of incubation, the yeast and *Agrobacterium* cultures were plated on SD (synthetic dropout) agar plates with 0.1% 5-FOA, 50 mg/L uracil, 500 mg/L carbenicillin and 200 mg/L cefotaxime. After two days of selection colonies were examined with PCR.

Spacers PWsp1409 (SEQ ID NO:59) and PWsp1410 (SEQ ID NO:60) target the yeast URA3 locus. The predicted cut site with LbCas12a for each spacer may result in the disruption of a NcoI or EcoRV restriction site, and therefore may be screened by PCR amplification, digestion with NcoI or EcoRV, and Sanger sequencing. Yeast colonies on plates containing 5-FOA were picked and colony PCR was performed on them to amplify a 1,000 bp fragment of the URA3 locus with primers PM10271 (SEQ ID NO:154) and PM10272 (SEQ ID NO:155). PCR products were digested with no enzyme, NcoI or EcoRV and run on an agarose gel. All samples that showed no digestion (full-length fragment, suggesting the restriction site was disrupted) were purified and sent for sanger sequencing.

Example 3: Targeted Integration Through T-DNA Recruitment Using VirD2 Recruited by Cas12a

*Agrobacterium tumefaciens* deficient in VirD2 carrying the plasmids listed in Table 5 were each transformed into 4500 soy explants. Negative control constructs were transformed from a isogenic *Agrobacterium tumefaciens* which retained a functional VirD2 gene.

TABLE 5

Plasmids in *Agrobacterium tumefaciens* transformed into soy explants and a summary of shoots produced.

| Integration Target | Plasmid 1 | Plasmid 1 Editor | Plasmid 2 | Plasmid 2 Editor | Green Shoots |
|---|---|---|---|---|---|
| Soy Target A | pWISE3592 (SEQ ID NO: 81) | VirD2::SH3dom (SEQ ID NO: 186) | pWISE3788 (SEQ ID NO: 110) | 4xSH3lig::Cas12a (SEQ ID NO: 187) | 971 |
| Ef1 alpha (integration negative control) | pWISE3776 (SEQ ID NO: 83) | Cas12a (SEQ ID NO: 171) | | | 96 |
| Polyubiquitin (integration negative control) | pWISE3777 (SEQ ID NO: 84) | Cast2a (SEQ ID NO: 171) | | | 102 |
| Ef1 alpha | pWISE3592 (SEQ ID NO: 81) | VirD2::SH3dom (SEQ ID NO: 186) | pWISE3587 (SEQ ID NO: 106) | 4xSH3lig::Cas12a (SEQ ID NO: 187) | 307 |
| Ef1 alpha | pWISE3592 (SEQ ID NO: 81) | VirD2::SH3dom (SEQ ID NO: 186) | pWISE3588 (SEQ ID NO: 107) | 4xSH3lig::Cas12a (SEQ ID NO: 187) | 293 |
| Polyubiquitin | pWISE3592 (SEQ ID NO: 81) | VirD2::SH3dom (SEQ ID NO: 186) | pWISE3767 (SEQ ID NO: 108) | 4xSH3lig::Cas12a (SEQ ID NO: 187) | 198 |
| Polyubiquitin | pWISE3592 (SEQ ID NO: 81) | VirD2::SH3dom (SEQ ID NO: 186) | pWISE3768 (SEQ ID NO: 109) | 4xSH3lig::Cas12a (SEQ ID NO: 187) | 202 |
| Polyubiquitin | pWISE3108 (SEQ ID NO: 82) | VirD2::SH3dom (SEQ ID NO: 186) | pWISE3771 (SEQ ID NO: 111) | 4xSH3lig::Cas12a (SEQ ID NO: 187) | 46 |

In these experiments, VirD2 N-terminus was fused to a nuclear localization signal (NLS) followed by an SH3 domain and the C-terminus of VirD2 and expressed in *Agrobacterium* from SEQ ID NO:81. This VirD2 arrangement was shown to successfully lead to T-DNA transfer in Example 1. Alternatively, the SH3 domain was fused to the N-terminus of VirD2 and preceded by an NLS as in SEQ ID NO:82. The second plasmid present in the *Agrobacterium* encodes a T-DNA containing a targeted integration repair template (SEQ ID NO:100-111) and an expressed region encoding a 4×SH3 ligand fused to LbCas12a without an NLS. In such an arrangement, VirD2 must bind to LbCas12a through the SH3-SH3 ligand interaction and bring both the T-DNA and LbCas12a into the nucleus. Once inside the nucleus, LbCas12a then recruits the VirD2-T-DNA complex to the target recombination site.

In the case of the Soy Target A target, the repair template modified the endogenous MscI/HaeIII restriction site to replace it with an XbaI restriction site and also to prevent re-cutting by the Cas12a-guide complex. In the case of the polyubiquitin and EF1α target sites the repair templates includes a 1) 1kb left homology arm followed by 2) an in-frame fusion of P2A "self-cleaving" peptide followed by 3) an in-frame chloroplast transit peptide followed by 4) and in-frame aadA spectinomycin resistance gene followed by 5) a modified target sequence to prevent re-cutting by the Cas12a-guide complex after successful integration followed by 6) a 1 kb right homology arm.

The explants were selected on spectinomycin for expression of the aadA gene. In the experiment targeting the Soy Target A gene, aadA was expressed from a typical selectable marker cassette. In the experiments targeting EF1 alpha or polyubiquitin the aadA gene was expressed due to the in-frame fusion with the native target genes after a successful targeted integration event. Green shoots were non-destructively sampled for genomic DNA (gDNA) extraction.

Editing tools targeting the polyubiquitin and EF1α sites produced more green shoots than the negative control plasmids containing the repair templates without the presence of the VirD2-Cas12a complex. These increases were roughly 2× and 3×, respectively, and suggested a significant number of successful aadA targeted insertion events. The polyubiquitin target loci were screened for aadA insertion with PCR using a primer targeting the flanking region of the polyubiquitin gene 5' of the left homology arm (SEQ ID NO:113) and a primer specific to the aadA insert (SEQ ID NO:114); the product of said PCR expected to be 1,195 bp.

Figure 4:
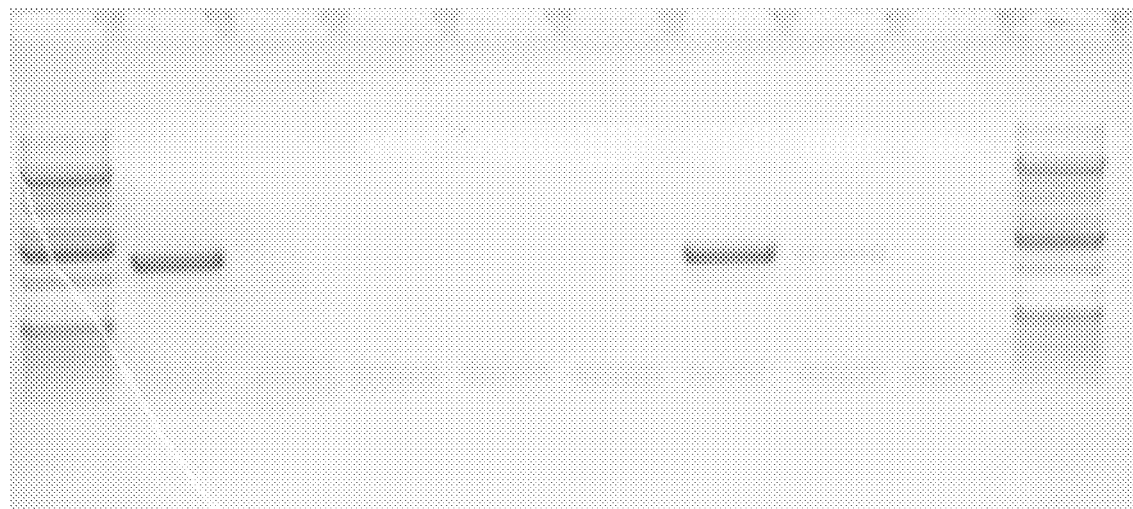
FIG. 4 is an image of a 1% agarose gel including RT-PCR products from samples corresponding to Box 1 wells A2, A6, A7, B2, C3, D3, F3 and F9 with GeneRuler 1 kb Plus DNA Ladder in wells 1 and 10. Samples A2, D3 and F3 produced the expected sized bands.

For some samples from the pWISE3592+pWISE3767 (SEQ ID NO:81 and 93) transformation (corresponding to Box 1 wells A2, A6, A7, B2, C3, D3, F3 and F9), additional samples were taken for RNA extraction. RNA was extracted using Qiagen RNeasy Plant mini kits. The total RNA was then treated with DNase I to remove any contaminating gDNA. Reverse transcription was performed with an aadA specific primer (SEQ ID NO:138) using Thermo Fisher SuperScript IV. PCR was then performed as in the gDNA screening reactions with a primer targeting the flanking region of the polyubiquitin gene 5' of the left homology arm (SEQ ID NO:113) and a primer specific to the aadA insert (SEQ ID NO:114); the product of said PCR expected to be 1,195 bp. FIG. 4 is an image of RT-PCR products from samples corresponding to Box 1 wells A2, A6, A7, B2, C3, D3, F3 and F9 run on a 1% agarose gel with GeneRuler 1 kb Plus DNA Ladder in wells 1 and 10. Samples A2, D3 and F3 produced the expected sized bands.

Figure 5:
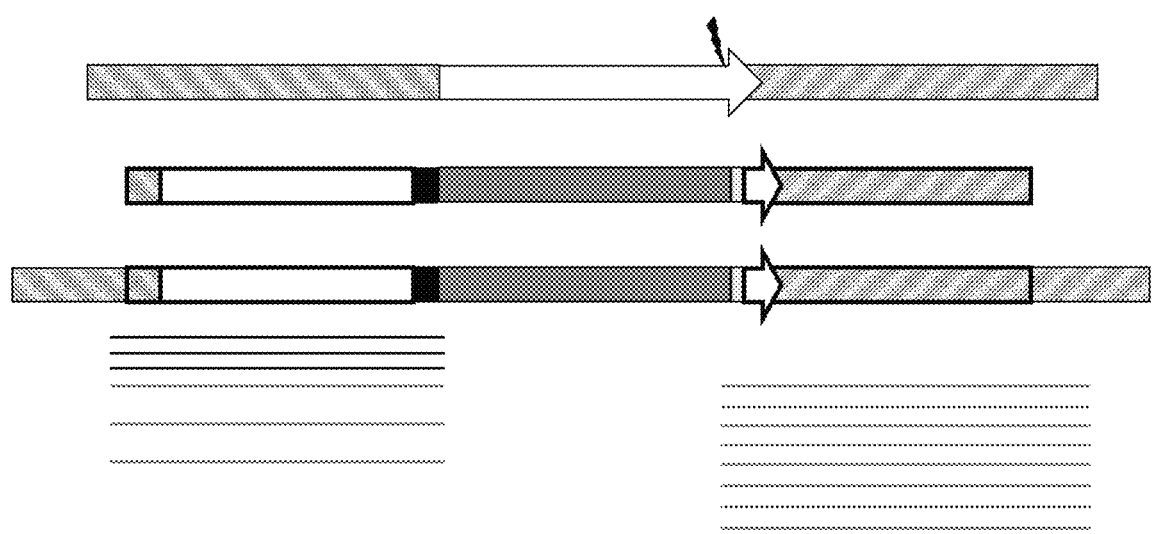
FIG. 5 is a diagram illustrating Sanger sequenced PCR products mapped to their regions of overlap on the targeted insertion.

Bands of the expected size were gel extracted and sequence confirmed to match an expected HDR repair (targeted integration) by Sanger sequencing. Sequence from A2 (SEQ ID NO:198), D3 (SEQ ID NO:199) and F3 (SEQ ID NO:200) confirmed that the polyubiquitin transcript pool contained sequence transcribed from a perfect HDR integration of aadA at the 3' end of the coding region of polyubiquitin. FIG. 5 shows (top) the polyubiquitin gene target with the transcribed region in the white arrow and the crRNA target site marked by a black lightning bolt; intergenic regions are in downward hatch marks (upstream of the transcript region) and upward hatch marks (downstream of the transcript region). Second from top is the repair template region included on the delivered T-DNA. Regions outlined in bold are left and right homology arms. The black box is the LP4-P2A self-cleaving peptide region, the dark gray box is the CTP-aadA encoding region, and the light gray box is an altered region meant to prevent repeated cutting by the Cas12a-crRNA complex after a repair. Third from top is a diagram of a perfect targeted gene insertion. The black lines below indicate Sanger sequenced RT-PCR products mapped to their regions of overlap on the targeted insertion, from samples A2, D3 and F3.

For some samples from the pWISE3592+pWISE3767 (SEQ ID NO:81 and 93) transformation, indicated as potential HDR positives, additional tissue could not be harvested at the time of the experiment for RNA extraction. For those samples, gDNA samples were amplified with primers for the native polyubiquitin locus flanking (outside) the region of homology contained within the HDR template (SEQ ID NO:149 and 142). The predominant product from these reactions was the wild type amplicon (2,324 bp). A semi-nested PCR from gel extracted DNA at the insertion product size (3,428 bp) using primers designed to specifically amplify the left flank to aadA junction (SEQ ID NO:113 and 114) produced the expected 1,242 bp product and/or a nested PCR using primers designed to specifically amplify the aadA junction to the right flank (SEQ ID NO:201 and 202) produced an expected band of 1,366 bp. This indicates that HDR was successful. Samples from Box 1 wells A2, A7, B2, B4, C2, E6, G7, G8 produced these DNA products which were gel isolated and Sanger sequenced confirming the perfect HDR integration of aadA at the 3' end of the coding region of polyubiquitin. In the diagram provided in FIG. 5, gray lines below the gene insertion diagram indicate Sanger sequenced PCR products mapped to their regions of overlap on the targeted insertion, from samples A2 (SEQ ID NO:203 and 204), A7 (SEQ ID NO:205), B2 (SEQ ID NO:206 and 207), B4 (SEQ ID NO:208), C2 (SEQ ID NO:209 and 210), E6 (SEQ ID NO:211), G7(SEQ ID NO:212) and G8 (SEQ ID NO:213).

Example 4: Targeted Integration Through T-DNA Recruitment by VirD2-Cas12a Fusion Proteins

*Agrobacterium tumefaciens* deficient in VirD2 carrying the plasmids listed in Table 6 were each transformed into 4500 soy explants. Negative control constructs were transformed from an isogenic *Agrobacterium tumefaciens* which retained a functional VirD2 gene.

TABLE 6

Plasmids in *Agrobacterium tumefaciens* transformed into soy explants and a summary of shoots produced.

| Integration Target | Editor | Plasmid 1 | Plasmid 2 | Green Shoots |
| --- | --- | --- | --- | --- |
| Soy Target A | Cas12a::VirD2 (SEQ ID NO: 66) | pWISE3104 | pWISE3387 | 734 |
| Soy Target A | Cas12a::VirD2 (SEQ ID NO: 66) | pWISE3104 | pWISE3388 | 759 |
| Ef1 alpha (aadA integration negative control) | Cas12a (SEQ ID NO: 171) | pWISE3776 | | 96 |
| Polyubiquitin (aadA integration negative control) | Cas12a (SEQ ID NO: 171) | pWISE3777 | | 102 |
| Ef1 alpha | Cas12a::VirD2 (SEQ ID NO: 66) | pWISE3452 | pWISE3352 | 101 |
| Ef1 alpha | Cas12a::VirD2 (SEQ ID NO: 66) | pWISE3452 | pWISE3358 | 55 |
| Polyubiquitin | Cas12a::VirD2 (SEQ ID NO: 66) | pWISE3452 | pWISE3361 | 219 |
| Polyubiquitin | Cas12a::VirD2 (SEQ ID NO: 66) | pWISE3452 | pWISE3362 | 171 |

In the case of the Soy Target A target, the repair template modified the endogenous MscI/HaeIII restriction site to replace it with an XbaI restriction site and also to prevent re-cutting by the Cas12a-guide complex. In the case of the polyubiquitin and EF1α target sites the repair templates includes a 1) 1kb left homology arm followed by 2) an in-frame fusion of P2A "self-cleaving" peptide followed by 3) an in-frame chloroplast transit peptide followed by 4) and in-frame aadA spectinomycin resistance gene followed by 5) a modified target sequence to prevent re-cutting by the Cas12a-guide complex after successful integration followed by 6) a 1 kb right homology arm.

The explants were selected on spectinomycin for expression of the aadA gene. In the experiment targeting the Soy Target A gene, aadA was expressed from a typical selectable marker cassette. In the experiments targeting EF1 alpha or polyubiquitin the aadA gene was expressed due to the in-frame fusion with the native target genes after a successful targeted integration event. Green shoots were non-destructively sampled for genomic DNA (gDNA) extraction.

The polyubiquitin site produced more green shoots than the negative control plasmid containing the repair template without the presence of the VirD2-Cas12a complex. This increase was roughly 2× and suggested a significant number of successful aadA targeted integration events. Because of this enrichment, the focus was on screening the polyubiquitin target locus for aadA insertion with PCR using a primer targeting the flanking region of the polyubiquitin gene 5' of the left homology arm (SEQ ID NO: 113) and a primer specific to the aadA insert (SEQ ID NO:114); the product of said PCR expected to be 1,195 bp.

For some samples from the pWISE3452+pWISE3362 (SEQ ID NO:80 and 90) transformation (corresponding to Box 1 wells B3, F9 and G7), additional samples were taken for RNA extraction. RNA was extracted using Qiagen RNeasy Plant mini kits. The total RNA was then treated with DNase I to remove any contaminating gDNA. Reverse transcription was performed with an aadA specific primer (SEQ ID NO:138) using Thermo Fisher SuperScript IV. PCR was then performed as in the gDNA screening reactions with a primer targeting the flanking region of the polyubiquitin gene 5' of the left homology arm (SEQ ID NO:113) and a primer specific to the aadA insert (SEQ ID NO:114); the product of said PCR expected to be 1,242 bp.

Figure 6:
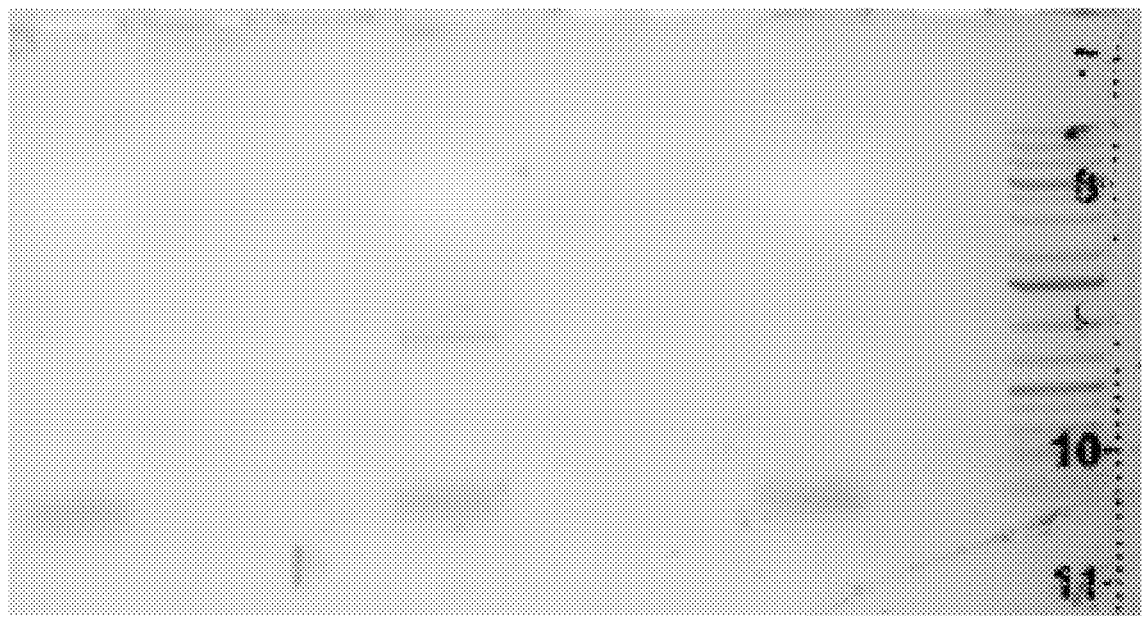
FIG. 6 is an image of a 1% agarose gel including RT-PCR products from samples corresponding to Box 1 wells B3 (lane 1), G7 (lane 4), F9 (lane 7) and GeneRuler 1 kb Plus DNA Ladder in lane 9.

FIG. 6 is an image of RT-PCR products from samples corresponding to Box 1 wells B3 (lane 1), G7 (lane 4) and F9 (lane 7) run on a 1% agarose gel with GeneRuler 1 kb Plus DNA Ladder in lane 9. Sample F9 produced slightly smaller than the expected sized band, which was extracted and Sanger sequenced.

Figure 7:
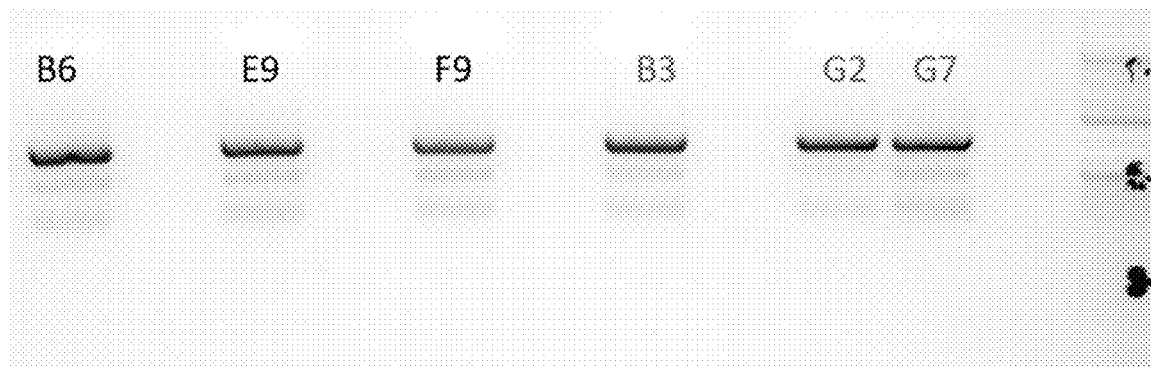
FIG. 7 is an image of a gel including semi-nested PCR products.

For some samples from the pWISE3452+pWISE3361 (SEQ ID NO:80 and 89) transformation and from the rom the pWISE3452+pWISE3362 (SEQ ID NO:80 and 90) transformation, indicated as potential HDR positives, additional tissue could not be harvested at the time of the experiment for RNA extraction. For those samples, gDNA samples were amplified with primers for the native polyubiquitin locus flanking (outside) the region of homology contained within the HDR template (SEQ ID NO:149 and 142). The predominant product from these reactions was the wild type amplicon (2,324 bp). A semi-nested PCR from gel extracted DNA at the insertion product size (3,428 bp) using primers designed to specifically amplify the left flank to aadA junction (SEQ ID NO:113 and 114) produced bands smaller than the expected 1,195 bp product (FIG. 7). Samples from pWISE3452+pWISE3361 (SEQ ID NO:80 and 89) wells B6, E9, F9 and pWISE3452+pWISE3362 (SEQ ID NO:80 and 90) wells B3, G2, and G7 produced these DNA products which were gel isolated and Sanger sequenced confirming the perfect HDR integration of aadA at the 3' end of the coding region of polyubiquitin. The FIG. 8 diagram gray lines below the gene insertion diagram indicate Sanger sequenced PCR products mapped to their regions of overlap on the targeted insertion, from samples B3 (SEQ ID NO:215), B6 (SEQ ID NO:216), E9 (SEQ ID NO:217), F9 (SEQ ID NO:218), G2 (SEQ ID NO:219), and G7 (SEQ ID NO:220). These results indicate that targeted integration was successful.

Figure 8:
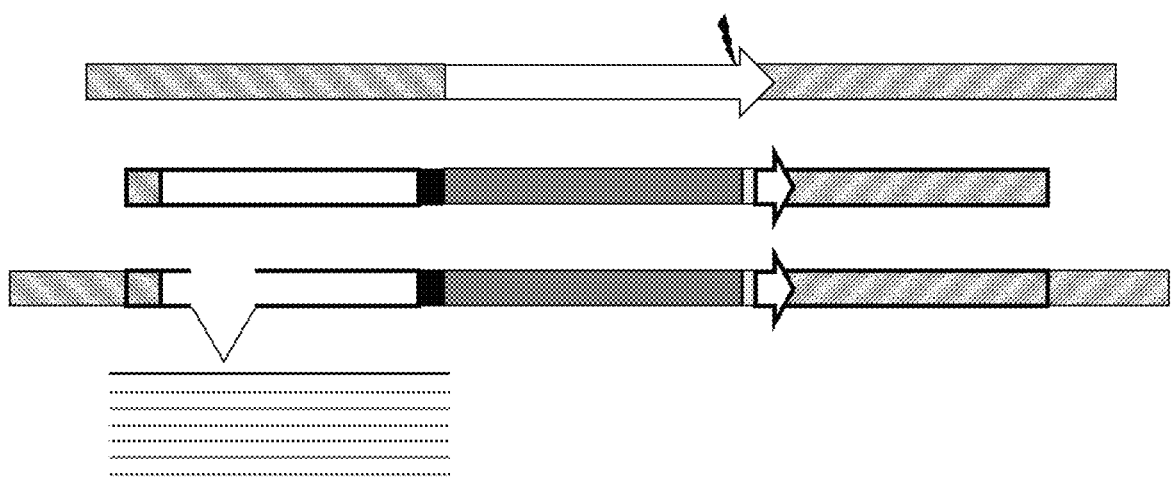
FIG. 8 is another diagram illustrating Sanger sequenced PCR products mapped to their regions of overlap on the targeted insertion.

FIG. 8 shows (top) the polyubiquitin gene target with the transcribed region in the white arrow and the crRNA target site marked by a black lightning bolt; intergenic regions are in downward hatch marks (upstream of the transcript region) and upward hatch marks (downstream of the transcript region). Second from top is the repair template region included on the delivered T-DNA. Regions outlined in bold are left and right homology arms. The black box is the LP4-P2A self-cleaving peptide region, the dark gray box is the CTP-aadA encoding region, and the light gray box is an altered region meant to prevent repeated cutting by the Cas12a-crRNA complex after a repair. Third from top is a diagram of a detected targeted gene insertion with a 228 bp deletion within the region covered by the left homology arm. The black lines below indicate Sanger sequenced RT-PCR product mapped to its region of overlap on the targeted insertion, from samples G7 (SEQ ID NO:214).

Further, this example of targeted integration demonstrates the capacity of the VirD2::Cas12a fusion protein to cut a genomic locus following secretion through the type-IV secretion system of *Agrobacterium*.

Example 5: T-DNA Delivery by VirD2 Fusion Proteins with Cas12a

The virD2 coding sequence from *Agrobacterium tumefaciens* C58 Ti-plasmid was fused to optimized coding sequences for gene expression in *Agrobacterium tumefaciens*. Three protein conformations were produced as described in Table 7. A VirD2 deficient *A. tumefaciens* strain was transformed with plasmid encoded vird2 expression cassettes and T-DNA encoding a plant optimized zsgreen.

TABLE 7

Treatments and plasmids used in VirD2-Cas12a fusion protein experiments

| Treatment | Delivered Plasmids |
|---|---|
| Cas12a::VirD2 (SEQ ID NO: 66) | pWISE3104 (SEQ ID NO: 79) + pWISE2737 (SEQ ID NO: 127) |
| VirD2::Cas12a::VirF (SEQ ID NO: 70) | pWISE3111 (SEQ ID NO: 125) + pWISE2737 (SEQ ID NO: 127) |
| VirD2::Cas12a (SEQ ID NO: 197) | pWISE3118 (SEQ ID NO: 126) + pWISE2737 (SEQ ID NO: 127) |
| Complementation control | pWISE3030 (SEQ ID NO: 119) + pWISE711 (SEQ ID NO: 124) |

Figure 9:
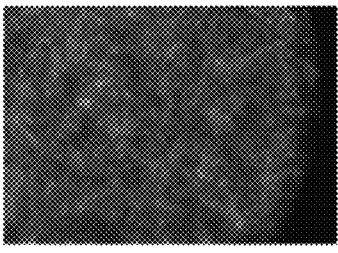
FIG. 9 shows fluorescent microscopy images, taken at 10-11 days after infiltration, of successful T-DNA encoded zsgreen delivery by modified VirD2 into the plant cell nucleus.

Leaves of four-week-old *Nicotiana benthamiana* plants were infiltrated with *A. tumefaciens* overnight cultures ($OD_{600\,nm}$, of 0.7 in infiltration buffer: 10 mM MES, 10 mM $MgCl_2$, 100 uM acetosyringone, pH 5.6). Validation of VirD2 functionality by delivery of a zsgreen encoding T-DNA into the plant cells was done via fluorescent microscopy 10-11 days post infiltration (dpi). FIG. 9 shows an example for successful T-DNA encoded zsgreen delivery by modified VirD2 into the plant cell nucleus. Fluorescent microscopy pictures were taken 10-11 days after infiltration.

The foregoing is illustrative of the present invention, and is not to be construed as limiting thereof. The invention is defined by the following claims, with equivalents of the claims to be included therein.

SEQUENCE LISTING (224 sequences)

SEQ ID NO: 1 - DNA, 1592 bp, Medicago truncatula
actgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagg

SEQ ID NO: 2 - DNA, 2000 bp, Zea mays
gtcgtgcccctctctagagataaagagcattgcatgtctaaagtataaaaaattaccacatatttttttgtcacacttatttgaagtgtagtttatctatctctatacatatatttaaacttcactctacaaataatatagtctataatactaaaataatattagtgttttagaggatcatataaataaactgctagacatggtctaaaggataattgaatattttgacaatctacagttttatctttttagtgtgcatgtgatctctctgttttttttgcaaatagcttgacctatataatacttcatccattttattagtacatccatttaggatttagggttgatggtttctatagactaatttttagtacatccattttattctttttagtctctaaattttttaaaactaaaactctattttagttttttatttaataatttagatataaaatgaaataaaataaattgactacaaataaaacaaataccctttaagaaataaaaaaactaagcaaacatttttcttgtttcgagtagataatgacaggctgttcaacgccgtcgacgagtctaacggacaccaaccagcgaaccagcagcgtcgcgtcgggccaagcgaagcagacggcacggcatctctgtagctgcctctggacccctctcgagagttccgctccaccgttggacttgctccgctgtcggcatccagaaattgcgtggcggagcggcagacgtgaggcggcacggcaggcggcctcttcctcctctcacggcaccggcagctacgggggattcctttcccaccgctccttcgctttcccttcctcgcccgccgtaataaatagacaccccctccacaccctctttccccaacctcgtgttcgttcggagcgcacacacacgcaaccagatctcccccaaatccagccgtcggcacctccgcttcaaggtacgccgctcatcctccccccccccctctctctaccttctctagatcggcgatccggtccatggttagggcccggtagttctacttctgttcatgtttgtgttagagcaaacatgttcatgttcatgtttgtgatgatgtggtctggttgggcggtcgttctagatcggagtaggatactgtttcaagctacctggtggatttattaattttgtatctgtatgtgtgtgccatacatcttcatagttacgagtttaagatgatggatggaaatatcgatctaggataggtatacatgttgatgcgggttttactgatgcatatacagagatgctttttttctcgcttggttgtgatgatatggtctggttgggcggtcgttctagatcggagtagaatactgtttcaaactacctggtggatttattaaaggataaagggtcgttctagatcggagtagaatactgtttcaaactacctggtggatttattaaaggatctgtatgtatgtgcctacatcttcatagttacgagtttaagatgatggatggaaatatcgatctaggataggtatacatgttgatgcgggttttactgatgcatatacagagatgctttttttcgcttggttgtgatgatgtggtctggttgggcggtcgttctagatcggagtagaatactgtttcaaactacctggtggatttattaattttgtatctttatgtgtgtgccatacatcttcatagttacgagtttaagatgatggatggaaatattgatctaggataggtatacatgttgatgtgggttttactgatgcatatacatgatggcatatgcggcatctattcatatgctctaaccttgagtacctatctattataataaacaagtatgttttataattattttgatcttgatatacttggatgatggcatatgcagcagctatatgtggattttttagccctgccttcatacgctatttatttgcttggtactgtttcttttgtccgatgctcaccctgttgtttggtgatacttc

SEQ ID NO: 3 - DNA, 4101 bp, Unknown
  Cas9 nt sequence
gacaagaagtactccattggcctggcgattgggacaaactcggtggggtgggccgtgattacggatgagtacaaggttccaagcaagaagttcaaggtcctcgggaacacagatcggcattcgattaagaagaatctcattggggcgctcctcttcgactcgggggagacagcggaggctaccaggctcaagcggacagccaggcggcggtacacaaggcggaagaatcgcatctgctacctccaggagattttctcgaatgagatggcgaaggtggacgacagcttcttccatcggctggaggagtccttcctggtggaggaggataagaagcacgagaggcatccaattttcgggaacatcgtggacgaggttgcgtaccatgagaagtaccctacaatctaccatctgcggaagaagctggttgactccacagacaaggcggacctgaggctgatctacctcgctctggcccacatgattaagttccgcgggcatttcctgatcgagggggacctgaatcccgacaattcggatgtggacaagctcttcatccagctggtgcagacctacaaccagctgttcgaggagaatcccatcaatgcgtcgggcgttgacgctaaggccattctgtccgctaggctgtcgaagagcaggaggctggagaacctgatcgcccagctgccaggcgagaagaagaatgggctcttcgggaatctgattgcgctctccctggggctgacaccgaacttcaagagcaatttcgatctggctgaggacgcgaagctccagctctcgaaggacacttacgacgatgacctcgataacctcctcgcgcagatcggggaccagtacgctgatctcttcctcgccgctaagaacctctcggatgctatcctgctctccgacattctccgggttaataccgagattacaaaggccccactgtcggcgtccatgatcaagcggtacgatgagcatcatcaggatctcaccctgctcaaggccctcgtgcggcagcagctgcccgagaagtacaaggagattttcttcgaccagagcaagaatgggtacgctggctacattgacggcggggcctcacaggaggagttctacaagttcatcaagccaatcctggagaagatggatgggacagaggagctgctggtgaagctcaaccgggaggatctgctcaggaagcagcggacgttcgacaacgggtcgattccccatcagatccacctgggggagctgcacgcgatcctgcgccggcaggaggatttctaccctttcctgaaggataatcgggagaagatcgagaagattctcaccttccggattccctactacgtcgggccactcgcgcggggcaatagcaggttcgcctggatgacacggaagagcgaggagacaatcaccccctggaacttcgaggaggttgtcgacaagggggcgtccgcccagtcattcattgagcggatgaccaatttcgacaagaatctgccaaatgagaaggttctcccaaagcatagcctcctctacgagtacttcactgtttacaacgagctgaccaaggtgaagtatgtgaccgagggcatgcggaagcccgcgttcctgtccggcgagcagaagaaggccattgtggacctcctgttcaagaccaatcgcaaggtcacagtcaagcagctcaaggaggattacttcaagaagatcgagtgcttcgactcggttgagattagcggggtggaggatcggttcaacgcgagcctcggcacttaccacgacctcctgaagatcatcaaggataaggacttcctcgacaacgaggagaacgaggatattctggaggacatcgtgctcaccctgacgctgttcgaggatcgggagatgatcgaggagcgcctgaagacctacgctcatctcttcgatgataaggtcatgaagcagctgaagaggaggcggtacaccgggtggggccgcctgagcaggaagctcattaacgggatcagggacaagcagagcggcaagaccatcctggacttcctcaagagcgatggcttcgccaaccggaatttcatgcagctcatccacgacgactccctcaccttcaaggaggacattcagaaggctcaggtcagcggccagggcgactcgctgcatgagcacatcgctaacctggcgggcagcccagccatcaagaagggcatcctccagacagtgaaggtcgtggatgagctggtgaaggtcatgggccggcataagcccgagaatattgtgattgagatggcgcgggagaatcagaccactcagaagggccagaagaactcgcgggagcgcatgaagaggatcgaggaggggattaaggagctgggcagccagattctcaaggagcaccccgtggagaatacccagctccagaacgagaagctgtacctctactacctccagaatgggcgggacatgtatgttgatcaggagctggacatcaatcgcctctcggattacgacgtggaccacatcgtgccccagagcttcctgaaggatgatagcatcgacaataaggtcctgacccgctccgacaagaatcgcggcaagagcgacaacgtgccgagcgaggaggtcgtgaagaagatgaagaactactggcggcagctgctgaacgcgaagctcattacacagcggaagttcgataacctgacgaaggcggagaggggcggcctctccgagctggacaaggcgggcttcattaagaggcagctcgtggagactcgccagatcaccaagcacgtggctcagatcctcgatagccggatgaatacgaagtacgatgagaatgacaagctcatccgggaggtgaaggtaatcaccctgaagtcaaagctcgttagcgatttccggaaggacttccagttctacaaggtgcgggagattaacaactaccatcatgcgcacgatgcgtacctcaatgcggtggtgggcacagccctgattaagaagtaccccaagctggagagcgagttcgtctacggggactacaaggtgtacgatgttcggaagatgatcgccaagagcgagcaggagattgggaaggccaccgctaagtacttcttctactcgaatattatgaatttcttcaagaccgagatcacactcgctaatggggagattcggaagcggcccctcatcgagactaacggggagactggcgagattgtgtgggacaaggggcgcgacttcgctaccgtgcgcaaggtcctctcgatgccccaggttaatattgttaagaagacagaggtgcagacgggcgggttctccaaggagtctatcctgccgaagcggaactcggacaagctgatcgcccgcaagaaggattgggaccccaagaagtacgggggattcgatagcccaaccgtggcttacagcgtcctggtggtcgccaaggttgagaaggggaagtcgaagaagctcaagagcgttaaggagctgctgggcatcaccatcatggagcggtccagcttcgagaagaatcctatcgacttcctggaggctaaggggtacaaggaggtcaagaaggacctgatcattaagctgcccaagtactctctgttcgagctggagaacgggaggaagcggatgctggcgtctgctggcgagctacagaagggcaatgagctggcgctcccctcgaagtatgtcaacttcctctacctggcttcccattacgagaagctgaagggctcgcccgaggataatgagcagaagcagctcttcgtggagcagcacaagcactacctcgacgagatcattgagcagatttcggagttctcgaagcgggtcattctcgcggacgcgaacctcgacaaggtcctctcggcgtacaacaagcaccgggacaagcccatccgggagcaggccgagaacattatccacctcttcacactgaccaacctcggcgctcccgccgcgttcaagtacttcgacaccaccattgaccgcaagagatacacatccaccaaggaggtgctggacgcgaccctcatccaccagagcatcacaggcctctacgagacacggatcgacctctcgcagctcgggggcgat

SEQ ID NO: 4 - DNA, 4092 bp, Unknown
  Cas9 nt sequence
gacaagaagtactcgatcggcctggcgattggcacaaacagcgtggggtgggctgtgatcactgatgagtacaaggtgccatcgaagaagttcaaggtgctggggaatacagaccggcattcgatcaagaagaatctcattggcgctctcctcttcgattccggcgagactgctgaggcgacccgcctgaagcgcaccgcccggcggcgctacactcggcggaagaataggatttgctacctccaggagattttctcgaatgagatggccaaggtggatgacagcttcttccaccgcctggaggagtcgttcctggtcgaggaggacaagaagcatgagcggcaccctatcttcgggaatatcgttgatgaggtcgcctaccacgagaagtaccccactatctaccatctccgcaagaagctcgtggacagcacagataaggccgacctccgcctgatctacctcgccctcgcgcacatgattaagttccgggggcacttcctcattgagggggatctgaatcccgataactccgacgtggacaagctgttcatccagctggtgcagacatacaaccagctgttcgaggagaatcccatcaacgcgagcggcgtggacgctaaggccattctgtcggctaggctctcgaagtcgaggcggctggagaacctgattgcgcagctccccggcgagaagaagaacgggctgttcgggaatctcatcgccctctccctcggcctcacaccaaacttcaagagcaatttcgacctggctgaggacgctaagctgcaactctcaaaggatacatacgatgacgacctggacaatctcctggctcagatcggcgaccagtacgctgacctgttcctcgcggccaagaatctgtcggacgcgattctcctcagcgacatcctgcgcgtcaataccgagattacgaaggctccactgtctgcgtcaatgattaagcggtacgatgagcatcaccaggatctgaccctcctgaaggcgctcgtgcggcagcagctgcccgagaagtacaaggagattttcttcgatcagagcaagaatggctacgccggctacatcgacgggggcgcgagccaggaggagttctacaagttcatcaagcccatcctggagaagatggacggcaccgaggagctactcgtgaagctcaatcgggaggatctcctccggaagcagcggacattcgataacgggtctatcccacaccagatccacctcggcgagctgcatgcgattctgcggcggcaggaggatttctaccctttcctgaaggacaaccgggagaagatcgagaagatcctcacattccggattccatactacgtcggccccctggcgaggggcaatagccggttcgcgtggatgacaaggaagtccgaggagactattaccccgtggaatttcgaggaggtggttgacaagggcgcttccgcgcagagcttcattgagcggatgacaaacttcgacaagaatctccccaacgagaaggtcctgccgaagcatagcctcctgtacgagtacttcaccgtctacaatgagctaactaaggtcaagtatgtgacagagggcatgaggaagccagccttcctctcaggcgagcagaagaaggccattgtggacctcctgttcaagacaaaccgcaaggtgacagtgaagcagctgaaggaggattacttcaagaagattgagtgcttcgactcagtggagatttcaggcgtggaggatcggttcaacgcgagcctggggacttaccacgacctgctgaagattattaaggacaaggacttcctggataacgaggagaatgaggacatcctggaggatattgtgctcaccctcaccctgttcgaggacagggagatgattgaggagaggctcaagacctacgcgcacctgttcgatgacaaggtcatgaagcagctgaagaggcggcgctacactgggtggggccgcctgtcgcggaagctgatcaacggcattcgggataagcagtccgggaagaccattctggatttcctgaagtcggacggcttcgccaacaggaatttcatgcagctgatccacgacgactccctcaccttcaaggaggacattcagaaggcccaggttagcggccagggggactcactccacgagcatattgccaatctggccggctctccagctatcaagaagggcatcctgcaaacagttaaggttgttgacgagctggttaaggtcatggggcggcataagcccgagaacattgtcatcgagatggctcgggagaaccagacaactcagaagggccagaagaactccagggagcgcatgaagcggattgaggagggcattaaggagctggggtcccagatcctcaaggagcaccctgtcgagaacactcagctgcaaaacgagaagctctacctgtactacctccagaacgggcgggatatgtatgtggatcaggagctggacatcaacaggctctccgactacgacgtggatcacattgtcccacagtctttcctcaaggatgattccatcgacaacaaggtgctgacgcgcagcgacaagaatagggggaagtcggacaacgttccgagcgaggaggtcgtgaagaagatgaagaattactggaggcagctcctgaatgcgaagctgatcactcagaggaagttcgacaatctgacaaaggcggagaggggcgggctctcggagctggataaggcgggcttcatcaagcggcagctcgttgaaacccggcagatcaccaagcatgtcgcccagatcctcgatagccgcatgaacaccaagtacgatgagaacgacaagctcattcgggaggttaaggtcattacgctgaagtccaagctcgtcagcgacttcaggaaggatttccagttctacaaggttcgggagattaacaactaccaccacgcgcatgatgcgtacctgaacgctgttgtcggcactgctctcatcaagaagtacccaaagctggagtccgagttcgtctacggggactacaaggtctacgatgtccggaagatgatcgccaagtcggagcaggagatcgggaaggctactgcgaagtacttcttctacagcaacattatgaatttcttcaagacggagattacgctggcgaacggggagattaggaagaggcccctcattgagactaatggggagacaggcgagattgtttgggacaagggccgcgacttcgcgactgtgcggaaggtcctgtccatgccacaggtgaatattgttaagaagacagaggtgcagactgggggcttctcgaaggagagcattctcccaaagcggaacagcgataagctcatcgcgcgcaagaaggattgggaccctaagaagtacggcggcttcgattctcccactgtggcctactccgttctcgtggttgccaaggttgagaaggggaagtcgaagaagctgaagtcggtcaaggagctgctcgggattacaatcatggagcggagcagcttcgagaagaaccctattgatttcctggaggccaagggctacaaggaggttaagaaggatctcattatcaagctccctaagtactctctgttcgagctggagaatggccggaagaggatgctggcctcggctggcgagctacagaaggggaatgagctggccctcccgtcgaagtatgtgaatttcctgtacctcgcgtcgcactacgagaagctcaagggcagcccggaggataatgagcagaagcagctcttcgtggagcagcataagcactacctggacgagatcattgagcagatcagcgagttctcgaagcgggttattctggctgatgctaacctggacaaggttctgagcgcctacaataagcatcgcgacaagccgattcgcgagcaggcggagaatattatccacctgttcaccctcactaacctcggggctcccgcggccttcaagtacttcgataccacaatagataggaagcggtacacctcgacgaaggaggtcctcgacgccacactcatccatcagtcgattacaggcctgtacgagacacggattgacctctcgcagctg

SEQ ID NO: 5 - DNA, 4101 bp, Unknown
  Cas9 nt sequence
gacaagaagtattccataggcctggctatcggcaccaacagcgtgggctgggccgtcatcaccgacgagtacaaagtgccgagtaaaaagttcaaagtgctcggcaacaccgaccgccactccataaagaaaaacctgatcggggcgctcctgttcgacagcggcgagacggcggaggccacccgcttgaaacgcacggcccgacggcgctacacgcggcgcaagaaccggatctgttacctacaggagattttctctaacgagatggcgaaggtggacgactcgttctttcaccgcctcgaagagtccttcctcgtggaggaggacaagaaacacgagcgccacccgatcttcggcaacatcgtggacgaggtggcctaccacgagaagtacccgaccatctaccacctccggaagaaactcgtggacagcacggacaaggccgacctgaggctcatctacctcgccctggcgcacatgattaagttccggggccacttcctgatcgagggcgacctgaacccggacaacagcgacgtggacaagctgttcatccagctagtccagacctacaaccagcttttcgaggaaaaccccatcaacgccagcggggtggacgcgaaggcgatcctgtccgcccggctgagcaagtcccggcggctggagaacctcatcgcgcagttgcccggcgagaagaagaacgggctgttcgggaacctgatcgccctctccctggggctcaccccgaacttcaagtccaacttcgacctcgccgaggacgccaaactacagctgagcaaggacacctacgacgacgacctcgacaacctgctggcccagatcggggaccagtacgcagacctgttcctcgccgccaagaacctctccgacgccatcctgctgtcggacatcctgcgggtgaacacggagatcacgaaggccccgctctcggcctcgatgattaaacgctacgacgagcaccaccaggacttgaccctcctcaaggcgctggtccgccagcagcttcccgagaagtacaaggaaatctttttcgatcagagcaagaacgggtacgccgggtacatcgacggcggggcgtcccaggaggagttctacaagttcatcaagcccatcctggagaaaatggacgggaccgaggagctgctcgtgaagctcaaccgcgaagatttgctccgcaagcagcgcacgttcgacaacgggtcgatcccgcaccagatccacctgggcgagctgcacgcgatcctcaggcgtcaggaagacttctaccccttcctcaaggacaaccgcgagaagatagagaagattctgaccttcagaattccttattacgtgggcccgctggctcggggcaactcgcgcttcgcctggatgacgcgcaagtccgaggagaccatcaccccgtggaacttcgaggaggtggtggataagggtgcctcggcccagtccttcatcgagcggatgaccaacttcgacaagaacctgccgaacgagaaggtgctccccaagcacagcctgctctacgaatatttcacggtgtacaacgagctgacgaaggtcaagtacgtgaccgagggaatgaggaaacctgcattcctctccggggagcagaagaaagccatagtcgacctcctgttcaagaccaaccggaaggtcaccgtcaagcagctcaaggaggactacttcaagaagatcgagtgcttcgattcagtggagatcagcggcgtcgaggaccggttcaacgccagcctgggcacctaccacgacctgctcaagatcatcaaggacaaggacttcctcgacaacgaggagaacgaggacatcctggaggacatcgtgctgaccctgacgctcttcgaggaccgcgagatgatcgaggagcgcctcaagacctacgcccacctgttcgacgacaaggtgatgaagcagctcaagcggcggagatatactgggtggggccgcctctcccggaagctcattaacggtatcagggataagcagtccgggaagacgatcctcgacttcctcaagtcggacgggttcgccaaccgcaacttcatgcagctcatccacgacgactccctgacgttcaaggaggacatccagaaggcccaagtgtctggtcaaggtgactcgctccacgagcacatcgccaacctcgcgggcagcccggccatcaagaagggaatactccagaccgtcaaggtggtggacgagctggtgaaggtcatgggccgccacaagccggagaacatcgtcatcgagatggcgcgggagaaccagaccacgcagaaggggcagaaaaatagccgtgagcgcatgaagcgcatcgaggaggggattaaggagttgggcagccagatcctcaaggagcaccctgtggagaacacgcagttgcaaaacgagaagctctacctgtactacctccagaacgggagggatatgtacgtggaccaagaactggacatcaaccgcctgtccgactacgacgtggaccacatcgtgccgcagagcttcctcaaggacgacagcatcgacaacaaggtgctcacccggtccgacaagaatcggggcaagtccgacaacgtgcccagcgaggaggtcgtcaaaaagatgaaaaactactggcgacaactactgaacgccaagctcatcacccagcgcaagttcgacaacctcacaaaagccgagcgcggcgggttgagcgagctggacaaggccgggttcatcaagcgccagctcgtcgagacgcgccagatcacgaagcacgtcgcgcagatactcgacagccggatgaacaccaagtacgacgagaacgacaagctcatccgggaggtgaaggtcatcaccctcaagtcgaagctcgtgagcgacttccgcaaggacttccagttctacaaggtccgggagatcaacaactaccaccacgcccacgatgcttatcttaacgccgtggtggggacggccctcattaagaaatacccgaagctggagtcggagttcgtgtacggcgactacaaggtgtacgacgtcaggaagatgatcgccaagtccgaacaggagatcgggaaggccacggcgaaatacttcttctacagcaacatcatgaacttcttcaagaccgagatcaccctcgccaacggcgagatccgcaagcgcccgctcatcgagacgaacggggagaccggcgagatcgtctgggacaaggggcgcgacttcgccactgtgcggaaggtgctgtcgatgccccaggtcaacatcgtcaagaagacggaggtccagacgggcgggttcagcaaggagagcatcctgccgaagcgcaacagcgacaagctgatcgcccgcaaaaaggactgggatccaaaaaagtacggcggcttcgacagccccaccgtcgcctacagcgtcctcgtcgtcgctaaagtcgagaagggcaagtccaaaaagctcaagagcgtcaaggagctgctcgggatcaccatcatggagcggtccagcttcgagaagaacccaattgatttcctggaggcgaagggctacaaggaggtcaagaaagacctcatcataaagctgccgaagtactcactcttcgagctggagaacgggcgcaagcggatgctggcgtcggccggagagctccaaaagggcaacgagctggcgctgccgagcaagtacgtgaacttcctctacctggcgtcccactacgagaagctcaagggcagtccagaggataacgagcagaagcagctattcgtggagcagcacaagcactacctggacgagatcatcgagcagatcagcgagttctccaagcgcgtcatcctggcggacgccaacctggacaaggtgctgtccgcgtacaacaagcaccgcgacaagccgatccgcgagcaagccgagaacatcatccacctgttcaccctcacgaacctcggggcacccgccgccttcaaatatttcgacacgaccatcgaccgcaagcgctacaccagcacgaaggaggtgctcgacgccaccctgatccaccagagcatcaccgggctgtacgagacccgcatcgacctctcgcagctcggcggggac

SEQ ID NO: 6 - DNA, 4101 bp, Unknown
  Cas9 nt sequence
gacaagaagtacagtattggattggccatcgggacgaacagcgtgggctgggccgtcatcaccgacgagtacaaggtgccatccaagaagtttaaggttctggggaataccgaccgccactcgatcaagaaaaatctcatcggggcgctgcttttcgacagcggcgagacggcggaagcgacgcggctcaagcggacggctcgtcgccgttacacccggcgtaagaaccgcatctgttacctccaggagatattcagcaacgagatggcgaaggtggacgactcctttttccaccgtcttgaggagtccttcctggtcgaggaggacaagaagcacgagcgccacccgatcttcgggaacatcgtggacgaggtggcctaccacgagaagtaccccacgatctaccacctccgcaaaaaactcgtggactcaactgacaaggccgatttgaggcttatctacctcgccctcgcccacatgattaagttccgtgggcacttcctaatcgagggtgacctcaaccccgacaactctgacgtggacaagctgttcatccagcttgtgcagacctacaatcagctctttgaggagaatccgatcaacgcatctggtgtggacgcaaaggccatcctcagcgcgcggctgagcaagtctaggcggttggagaacctgatcgcccaactgcccggcgagaagaaaaatggcctcttcggcaacctgatcgccctgtcgctggggctcacgccgaacttcaagagtaactttgacctggcggaggacgctaagctccagctatctaaggacacatacgacgacgacctggacaacctgctggcccagatcggcgaccagtacgccgacctcttcctagccgccaagaacctgtccgacgccatcctcctcagcgacatcctgcgcgtgaacacggagatcacgaaggctccgctcagcgcctccatgattaagcggtacgacgagcaccaccaagacctaactttactcaaagccctcgtgcggcagcagcttcccgagaagtacaaagagatattttttgatcagtccaagaacggttatgcgggctacatcgacggcggcgcgagccaggaggagttctacaagttcatcaagcccatcctggagaagatggacggcacggaggagctgctcgtgaagctcaaccgtgaagacctcctgcgaaagcagcgaaccttcgacaacggttcgatcccgcaccagatccacctcggggagctgcacgccatcctgaggcgacaggaggacttctaccctttcctaaaggacaaccgcgagaagattgaaaaaatcctgacgtttcgcataccctactacgtcggcccgctggcgcgcggcaactcccggttcgcctggatgacccgtaagagcgaggagacgatcaccccgtggaacttcgaggaggtcgtggacaagggcgcgagcgcgcagagcttcatcgagcgcatgaccaacttcgacaagaacctcccgaacgagaaggtgctcccaaagcactccctcctgtacgagtatttcaccgtgtacaacgagttgacaaaggtgaagtacgtgacggagggaatgcggaagcctgcgttcctctcgggcgagcagaagaaggcaatcgtggacctgctcttcaagaccaaccggaaggtgacggtgaagcagctcaaggaggactacttcaaaaaaatcgagtgcttcgactccgtggagataagcggcgtggaggaccgattcaacgcctccctcggcacctaccacgacctccttaagatcatcaaggacaaggacttcctggacaacgaggagaacgaggacatcctggaggacatcgtgctcaccctgaccctcttcgaggaccgggagatgatcgaggagcgcctcaagacgtacgcccacttgttcgacgacaaggtgatgaagcagctcaagcggcggcgatacaccgggtggggccgcctatcccgcaaacttatcaacggcatccgcgacaagcagtccggcaagacgatcctggatttcctcaagtcggacgggttcgccaaccggaacttcatgcagctcatccacgacgacagcctcacgttcaaggaggacatccagaaggcccaagtgagcggtcaaggggacagcctccacgagcacattgcgaaccttgctgggagccctgcgatcaagaaggggatattgcaaaccgtgaaggtcgtggacgagttggtgaaggtcatggggcgacacaagcccgagaacatcgtgatcgagatggccagggaaaatcagaccacgcagaagggccaaaaaaacagccgcgagcggatgaagcggatcgaggagggcatcaaggagctggggtcgcagatcctcaaggagcacccggtggagaacacgcagctccagaacgagaagctgtacctctattacctacagaacgggcgggatatgtacgtggaccaggagctagacatcaaccgcctgtccgactacgacgtggaccatatcgtcccgcagtcgttcttgaaggacgacagcatcgacaacaaggtgctcacaagatcggataagaatcgaggcaagtccgacaacgtgccctcggaggaggtggtcaagaaaatgaaaaactactggcggcagttgctgaacgccaagctcattacgcagcggaagttcgacaacctgacgaaggctgaacgtggtgggctcagcgagctagacaaggcggggttcatcaagcggcagctcgtcgagacccggcagatcaccaagcacgtggcgcagatcctggactcgcgcatgaacaccaagtacgacgagaacgacaagctcatccgtgaggtgaaggtcatcacccttaagtctaagctggtcagtgacttccgcaaggacttccagttctacaaggtccgggagatcaacaactaccaccacgcgcacgacgcctacctcaacgcggtggtggggacggcgcttattaagaaatatcccaagctggaaagcgagttcgtttacggcgactacaaggtgtacgacgtccgcaagatgatcgcaaagtcggaacaggaaatcggaaaggcgacggccaaatatttcttttactccaacatcatgaatttttttaagacggagatcaccctggcgaacggggagatccgcaagcggcccctcatcgagaccaacggggagacgggcgagatcgtctgggacaagggccgggacttcgccaccgtgcggaaggtgctttctatgcctcaagtcaatatcgtcaaaaagacagaggtgcagaccggcgggttcagcaaggagtctatcctgccgaagcgcaactcggacaagctcatcgcgcgcaagaaagactgggaccccaaaaaatatggcgggttcgactcgccgaccgtcgcctacagcgtcctcgtggtggctaaggtcgagaagggcaagagcaaaaagctaaagtcggtgaaggagctgctgggcatcaccatcatggagcgctcgtctttcgagaagaatccaatcgacttcctagaggcgaaggggtacaaggaggtcaaaaaggatcttatcatcaaactgccgaagtacagtctgttcgagctggagaacgggcggaagcggatgctggctagtgcgggcgagttgcagaagggcaacgagttggcactgccctccaagtacgtgaacttcctgtacctggcctcccactacgagaagctcaaggggagccccgaggacaacgagcagaagcagctattcgtcgagcagcacaagcactacctggacgagatcatcgagcagatcagtgagttctccaagcgggtcatcctcgcggacgccaacctggacaaggtgctgagcgcgtacaacaagcacagggacaagccaatcagggaacaggccgagaacatcatccacctgttcaccctgaccaacctgggtgcaccggctgccttcaagtactttgacacgaccatcgaccggaagcgctacacctccacgaaggaggtgctggacgccacgctgatccaccagagcatcaccgggctctacgagacacggatcgacctgagccagcttggcggggac

SEQ ID NO: 7 - DNA, 4092 bp, Unknown
  Cas9 nt sequence
gacaaaaagtattccattggactcgctatcggcacgaacagcgtcgggtgggcggtcatcactgacgagtacaaggtgccgagcaagaagtttaaggtgctgggaaacaccgacaggcactcgatcaagaaaaatcttatcggggccctactcttcgactccggagaaaccgccgaggccacccggttgaagcgcacggcccgccgtcgctacaccaggcgcaagaaccggatctgctacctccaggagatattcagcaatgagatggcgaaggtggacgactcgttttttcacaggctagaggagtctttcctcgtggaggaggacaagaaacacgagcgccaccccatcttcggcaacatcgtggatgaggtggcatatcacgagaagtacccaaccatctaccacctccgcaaaaagctcgtggactctaccgacaaggccgacctccgtctgatctacctcgcgctggcccacatgattaagttccgaggacactttctgatcgagggcgacctgaacccagacaacagcgacgtggacaagctgttcatccaacttgtccagacctacaatcagctcttcgaggagaaccctatcaacgcctcgggcgtggacgcgaaggccatcctgtccgcccgcctgagcaagtcgcggcggctggagaacctgatcgcccagctccccggcgaaaaaaagaacggcctcttcggcaacctcatcgcgttgtcgctggggctcaccccgaacttcaagtccaacttcgacctggccgaggacgctaaactccagctctcgaaggatacctacgacgacgacctcgacaacctgctggcccagatcggcgaccagtacgcggaccttttcctggcggccaagaacctgagcgacgcgatcctccttagcgacatactccgtgtgaacaccgagatcacgaaggccccgctctccgcgtccatgattaagcgctacgacgagcaccaccaagaccttaccctgcttaaggcgctggtcaggcagcagttaccggagaagtacaaggagatcttttttgatcaatctaagaacggttacgccgggtacatcgacggcggcgcgtcccaggaggagttctacaagttcatcaagccgatcttggagaaaatggacgggaccgaggagctgctcgtgaagctcaaccgcgaagacctcctccgcaagcagcgcaccttcgacaacgggagcatcccgcaccagatccacctgggagagctgcacgcgatcctgcggagacaagaggacttctaccccttcctcaaggacaaccgggagaagattgaaaaaatacttacttttcgtatcccgtactacgtcgggccccttgcgaggggcaactccagattcgcgtggatgacccgcaagtccgaggagaccatcaccccgtggaacttcgaggaggtggtggacaagggcgcgtcggcccagtcgttcatcgagcgcatgaccaacttcgacaagaaccttccgaacgagaaggtgctcccgaagcacagcctgctctacgaatattttactgtgtacaacgagctgacgaaggtcaagtacgttacggaggggatgaggaagcccgccttcctctccggcgagcagaagaaagccattgtggatctcctgttcaagaccaaccgcaaggtgacggtgaaacagctcaaagaggactacttcaagaagatcgagtgcttcgactccgtagagatcagcggggtcgaggaccgcttcaacgcctcgctgggcacgtaccacgacctgctaaagattatcaaggacaaagacttcctagacaatgaggagaacgaggacattctggaggacatcgtgctgactctgacgctgttcgaagaccgcgagatgatcgaggagcggcttaagacgtacgcccacctgttcgacgacaaggtgatgaagcagttgaaacggcggcgctacaccgggtggggccgcctctcccgcaagctcatcaacggcatccgcgacaagcagtcggggaagacgatcctggacttcctcaagagcgacggcttcgccaaccgaaacttcatgcagctaatccacgacgacagcctgacgttcaaggaggacatccagaaggcccaagtgagcggccagggagactcgctacacgagcatatcgccaacctggctggcagcccggcgattaagaaaggaatcctccaaaccgtcaaagtggtggacgagctggtgaaggtgatgggccgccacaagcccgagaacattgtgatcgagatggcgcgggagaaccagacgacgcagaagggccaaaaaaatagcagggaaaggatgaagcgaatagaggaggggatcaaggagctggggagccagattctcaaagagcacccggtcgagaacacacagctccagaacgagaagctgtacctctactacctccaaaacggccgcgatatgtacgtggaccaggaactagacatcaaccggctgagcgactatgacgtggaccacatcgtgccgcagtccttcctcaaggacgactcgattgacaacaaagtgctcactagatccgacaagaacagaggcaagagcgataacgtcccgtcggaggaggtcgtcaagaaaatgaaaaactactggcggcagctcctaaacgccaagctcatcacgcagcgtaagttcgacaacctgacgaaggcggagcggggcgggctgagcgagctggacaaagcggggttcatcaagcggcagctcgttgagacgcggcagatcacaaagcacgtcgcgcaaatcctcgactcccgcatgaacaccaagtacgacgagaacgacaagctcatccgggaggtgaaggtcattacccttaaatcgaagctcgtcagcgactttcgtaaggacttccagttctacaaggtcagagagatcaacaactaccaccacgcccacgacgcctatctgaacgccgtggtgggcaccgcgcttattaagaagtaccccaagctggagtccgagttcgtgtacggcgactacaaggtttatgacgtcaggaagatgatcgccaagtcggaacaggagatcggaaaagctaccgccaaatatttcttctatagcaacatcatgaacttcttcaaaaccgagatcaccctcgccaacggcgagatccggaagcgcccgctcatcgagaccaacggggagaccggggagatcgtctgggacaaggggcgggacttcgctactgtccgaaaggtgctctccatgccacaagtgaatatcgtcaagaaaacagaggtgcagaccggagggttcagtaaggagtccatcctgcccaagcggaactccgacaagctaattgctcgcaaaaaggattgggatcctaaaaaatatggcggcttcgactcgcccacggtcgcctactctgtgctggtcgtggcgaaggtggagaagggcaagtccaagaagctcaagagcgtcaaggagctgctggggatcacgatcatggagcgtagttcgtttgagaagaatcccatcgacttcctggaggctaagggctacaaggaggtcaaaaaggacctcatcattaagctgccgaagtacagcctcttcgagctggagaacgggcggaagcgtatgctcgcctccgctggggagttacaaaaggggaacgagctggcgctgccgtctaagtacgtcaacttcctgtacctggcctcccactacgagaagctcaaggggtcgccggaggacaacgagcagaagcagctcttcgtagagcagcacaagcactacctggacgagatcatcgagcagatttcagagttctcaaagcgggtcatcctcgccgacgccaacctggacaaggtgctctcggcctacaacaagcaccgggacaagccgatccgcgaacaggccgaaaacatcatccacctgttcacgctcaccaacctcggtgccccggcggccttcaagtactttgacacgaccatcgaccggaagcgctatacctcgacgaaggaggtgctggacgccaccctgatccaccagtccatcaccgggctttacgagacccggatcgacctctcgcagcta

SEQ ID NO: 8 - DNA, 4101 bp, Unknown
  Cas9 nt sequence
gacaagaagtatagtattggactcgccatcggaaccaactctgtggggtgggctgttattacagatgaatataaggtgccatccaaaaagtttaaagttctgggcaatactgatagacactcaatcaagaagaatctgataggtgcacttctgtttgatagtggagagactgccgaggcaaccagacttaaaaggactgcaagaagaagatataccagaagaaagaataggatttgctatttgcaggaaatcttcagcaacgaaatggccaaggttgatgactcatttttccataggttggaggagagttttcttgtggaggaagataagaagcacgaaagacacccaattttcgggaatatagtggacgaggtggcttatcatgagaagtatcccactatctaccacctgagaaagaaacttgtggactcaaccgataaggctgatcttaggcttatatacttggcccttgcacatatgatcaaattcaggggccattttcttatcgaaggcgatcttaatcccgataactcagatgtggacaagctgtttatacaacttgtgcaaacctacaatcaactcttcgaggagaatcccattaacgcctccggcgtggatgcaaaagccatactgtcagccagactgagcaaaagtaggagactggagaatcttatagcccaactgcccggtgaaaagaagaatgggctcttcggaaatctgatcgctctttcattggggttgacacccaactttaagagtaactttgacttggcagaagatgcaaagttgcagctcagtaaagacacatatgacgatgaccttgacaatctcttggcacaaataggggatcaatacgctgaccttttcctcgctgccaagaacctcagcgacgctatactgttgtccgacattcttagggttaataccgaaattacaaaggcccctcttagtgcaagtatgatcaaaaggtatgatgagcatcaccaagaccttacactgctgaaggctctggttagacagcaactccctgaaaagtataaggaaatattcttcgaccaaagtaagaacgggtacgccggttatattgatgggggcgcaagtcaagaagaattttacaaattcatcaagccaattcttgaaaagatggacgggactgaggaattgctggtgaaactgaatagagaggaccttcttagaaaacagaggacatttgacaatgggtccatcccacaccagattcatctgggggaactccacgcaatattgaggagacaagaagacttttacccattccttaaggataatagagagaaaatcgaaaaaatcctgactttcaggattccttactatgttgggccactggccagggggaactcaagattcgcttggatgacaaggaagtcagaagaaaccataaccccttggaattttgaagaggtggttgataagggggcatcagcccagtctttcatagagaggatgaccaactttgataaaaatcttccaaatgagaaggttttgccaaaacatagtcttttgtacgagtactttactgtttataacgaattgaccaaggtgaagtatgtgaccgagggaatgaggaagccagcatttttgtccggggagcaaaagaaagcaatcgttgatcttctcttcaagaccaacagaaaagtgaccgtgaaacaactgaaggaagactacttcaaaaagatagaatgtttcgattcagtggaaattagcggtgttgaagacaggttcaatgcttcattgggtacttaccacgacctgttgaagataatcaaagacaaggactttctcgataatgaggagaacgaagacatcttggaagacattgtgcttacactcactttgtttgaggacagggaaatgattgaggaaagactcaaaacttacgctcatttgtttgatgataaggttatgaaacaactaaaaagaagaaggtacaccggctggggaagattgagtaggaaactgatcaacggtattagagataaacaatccggaaagactatcctcgatttccttaagagtgatggctttgcaaataggaattttatgcagctgattcatgacgactcacttaccttcaaagaagacatccaaaaagctcaggtgtctgggcaaggcgacagtctgcatgaacatatagctaacttggctgggagtcccgccatcaagaaggggatacttcaaacagttaaagttgtggacgaattggtgaaggtaatgggaaggcacaagcctgaaaatatagtgatagaaatggcaagggaaaatcaaacaacccagaagggacagaagaacagtagggaaaggatgaaaaggatagaagaggggatcaaagagcttggtagccagatcctcaaggaacatccagtggagaatacccaacttcaaaacgagaaactctatttgtactacttgcagaacggaagagatatgtatgtggaccaagagcttgatattaacaggctgagcgattatgacgttgaccacatagtgccccaatcattcctcaaggatgactctattgataataaggtgctgacaaggagtgacaagaatagagggaaatccgacaacgttccatccgaggaagttgtgaagaagatgaagaactactggaggcagttgctgaacgctaagctcattacccagaggaaattcgataacctgaccaaagcagagagaggcgggctgagcgaactcgataaagcaggtttcatcaagagacaactcgtggagactaggcaaattactaagcacgtggctcaaatactcgacagcaggatgaacacaaagtacgacgagaacgacaagctcattagagaggttaaggttattactctgaaaagtaaattggttagcgatttcagaaaggatttccaattctataaggttagagagatcaacaattatcatcatgcacatgatgcctatctgaatgctgtggttggtacagcccttatcaagaagtaccctaagctagagagcgagtttgtgtacggagattataaggtgtatgatgtgaggaaaatgatcgctaaaagtgagcaagagattggaaaggctaccgccaaatacttcttttattccaatattatgaatttcttcaagacagaaatcaccctggctaacggcgagataaggaagaggccgcttatcgaaactaatggggagacaggcgaaatagtgtgggacaaagggagggatttcgcaactgtgaggaaggttttgagcatgcctcaggtgaatatcgttaagaaaaccgaagttcaaactggagggttctctaaggaaagcattctccccaagaggaactccgacaagctgattgctagaaagaaagactgggaccccaagaagtatggcggattcgactcacccactgtggcatatagcgttctcgtggtggcaaaggttgaaaagggtaaatccaaaaaactcaaatccgtgaaggaactccttggcataactattatggaaaggagtagctttgaaaagaatcccatcgactttctcgaagctaagggctataaggaagttaagaaggaccttataatcaaacttccaaaatactccctttttgagttggaaaacggcagaaagagaatgttggccagtgccggggagcttcaaaagggcaacgaactggctctgcctagcaaatatgtgaactttttgtatctggcatcacactacgagaaacttaaaggctctcctgaggacaacgagcaaaaacagctctttgttgaacagcataagcactacctcgacgagattattgagcagatcagcgagttctcaaagagagttattctggctgacgctaatcttgacaaggttttgtccgcttacaacaaacacagggataagccaatcagggagcaggcagaaaacataatccatctctttaccctgacaaacctcggtgcccccgctgctttcaagtattttgatactaccattgacaggaagagatatacttccactaaggaagtgctcgacgcaaccctcatacaccaaagtatcacaggcctctatgaaactaggatagatttgtctcaacttgggggcgat

SEQ ID NO: 9 - DNA, 4101 bp, Unknown
  Cas9 nt sequence
gacaaaaagtattccatcgggcttgctatcggaaccaactctgtggggtgggcagttattaccgacgaatacaaggtgcccagcaagaagtttaaggttctggggaacacagatagacatagcataaagaaaaacctgataggcgcactgttgttcgactccggggaaacagccgaagctaccaggctgaagagaactgcaagaagaaggtacaccagaagaaaaaacagaatatgttatctccaagagattttctctaacgagatggccaaggtggacgactcattctttcacagactggaagaatctttccttgtggaagaagataagaaacacgagaggcaccctatttttggcaatatcgtggatgaggtggcttaccacgaaaaataccctacaatataccacctcaggaaaaaattggttgatagtacagacaaggccgacctcaggctcatctatttggccctggcccatatgattaaattcagggggcactttctcatcgagggagatttgaaccccgacaacagtgatgttgataagctctttattcagctcgtgcagacttacaatcagttgtttgaggaaaaccccattaatgcttccggggtggacgccaaggcaatcctttctgcaagactctcaaagtcaaggagactcgaaaatctgatagcacagcttccaggagagaagaagaacgggctctttggaaacctgatcgctctgtcactcggactcacacccaatttcaaaagcaattttgatttggcagaggacgctaagctgcaactcagtaaggatacctacgacgatgacttggataatctgctcgcacaaattggggaccagtatgcagacctgtttctcgcagctaagaacttgagtgacgccatattgctcagtgacatcctcagggttaataccgagattacaaaagctccactctctgcaagcatgatcaagaggtatgacgagcaccatcaagacctgacactccttaaggcgttggttaggcagcaacttcctgaaaagtataaggaaatcttcttcgatcaaagcaaaaacggctacgccggctatatagacgggggagcatcccaagaagaattttataagttcataaaacctatattggagaagatggacgggacagaggaattgctcgtgaaactgaacagggaggatctcctcaggaagcaaaggaccttcgacaatggctccatcccacatcagattcacctcggcgaactgcacgcaatactgagaagacaagaggacttttatcctttcctgaaggacaacagggagaaaatcgagaaaatcttgacattcagaatcccatactacgttgggcctctggccagaggtaacagtaggttcgcctggatgactaggaaatcagaggagactattacaccctggaactttgaagaagttgttgataagggagcttcagcacaatcattcatcgaaagaatgacaaactttgacaaaaatctgcctaatgagaaagtgctcccaaaacattccctgctgtatgagtattttaccgtttataacgagcttaccaaggtgaaatacgttactgaaggtatgagaaagccagcttttctttcaggggagcaaaagaaggctatcgtggatcttctctttaagaccaacagaaaggttaccgtgaagcagcttaaggaagactactttaaaaagatcgagtgttttgactcagtggaaataagcggtgttgaagatagattcaacgcatccttgggaacttatcatgatcttcttaagataatcaaggataaagactttctcgacaacgaggaaaacgaagatatactggaggacatagttctgacacttactttgttcgaggatagggagatgatcgaggaaagactgaaaacatatgctcaccttttcgacgacaaagttatgaaacaactcaagagaaggagatatacagggtgggggagattgagcaggaaactgattaatggtatcagagacaaacagtcaggaaaaacaatactcgactttttgaaatcagacgggttcgcaaataggaatttcatgcagcttatacacgacgattcacttacttttaaagaggacattcaaaaggctcaagttagtggacaaggtgactccctccacgaacacatcgcaaatctcgctggcagccctgcaattaagaagggtatactccagacagttaaggttgttgacgagctggttaaagtgatgggaagacacaaacccgagaacatagtgatagagatggccagggaaaaccaaaccactcaaaaagggcagaaaaattccagagagaggatgaaaaggattgaagaaggtatcaaggagctgggtagccaaattctgaaagaacatcctgtggaaaacactcaactccagaatgagaaactctatctgtactatctgcaaaatgggagagatatgtatgtggaccaggaactggacataaacaggctctcagattacgatgtggatcatatcgtgccacagtcctttcttaaggatgatagcatcgacaataaggtgcttaccaggtccgacaagaacaggggaaagtcagataacgtgccttctgaagaagttgttaaaaagatgaagaactactggagacagctgcttaacgctaagctcataacacagaggaagtttgacaacttgaccaaggccgagagaggcggactctcagaattggataaggcagggttcataaaaaggcagctggtggaaacaaggcagataactaaacatgtggctcagatcctcgatagtaggatgaatacaaaatacgatgagaacgacaagctcataagggaggttaaagtgataactctgaaatccaaactggttagcgattttaggaaggatttccagttttacaaagttagggagatcaacaattatcatcacgcccacgatgcctacttgaacgcagttgtgggtactgcacttatcaaaaagtaccctaagctggaatccgagtttgtttatggagactataaggtgtacgacgttagaaaaatgattgcaaagtcagagcaggagatagggaaagccactgcaaaatatttcttttatagcaatatcatgaatttctttaagacagaaatcacactggccaatggggaaataaggaagaggcccctgatcgaaactaatggcgagacaggggagattgtgtgggataaaggtagggactttgcaacagtgaggaaagtgctgagcatgccccaagttaatatcgttaaaaagaccgaggttcaaacagggggctttagtaaggaaagcattttgcccaagaggaatagtgacaaattgattgctaggaaaaaagattgggaccccaaaaagtatggcggatttgatagccccactgttgcttactccgtgctcgtggttgcaaaggtggagaagggaaagagcaagaaactgaagtcagttaaggaactccttggtatcactatcatggaaagaagctcctttgagaagaaccctattgacttcctggaggctaaagggtacaaagaggttaagaaagaccttatcattaaattgcccaaatatagtcttttcgagcttgaaaacggaagaaagaggatgcttgcatccgctggcgaattgcaaaagggcaatgagcttgctctcccttccaagtatgtgaacttcctttatcttgcctcacactatgaaaaactcaaaggttcacccgaagacaacgaacaaaagcaactatttgtggaacaacacaagcactacctggacgaaatcattgagcaaatttctgagttttcaaaaagggtaatcttggctgacgcaaatctcgacaaagttttgtcagcttacaacaaacatagagataagccaattagagagcaagctgagaatatcatccatctgtttaccctgactaaccttggagcgcctgctgcttttaaatatttcgacaccacaatcgacaggaagaggtacactagcactaaggaagttctcgacgccaccctcatccaccagagtattacaggcctgtacgagacaagaattgatctttctcaacttggtggtgac

SEQ ID NO: 10 - DNA, 4101 bp, Unknown
  Cas9 nt sequence
gataagaagtactcaatcggtctggcaatcggaaccaactctgtgggttgggcagtgattacagatgagtataaggtgccaagcaaaaaattcaaggtgctgggtaataccgacagacacagcattaagaagaatttgattggagcactcctctttgactcaggggaaacagcagaggcaacaaggctgaagaggacagcaaggcggaggtacacaaggcggaaaaacaggatatgctacctccaggaaatctttagcaacgagatggctaaagtggatgatagctttttccatagactcgaagaatcctttcttgttgaagaggacaaaaagcatgaaaggcatcccatcttcggcaatatagttgatgaggttgcataccatgagaagtaccccacaatctaccacctcagaaagaaacttgtggactccacagataaagcagacctgaggctcatatacctcgcactcgcacacatgatcaagttcagagggcactttctcatcgaaggtgacctgaatccagataattcagatgtggataaactgtttatacagctggtgcaaacatacaaccaacttttcgaggaaaacccaatcaatgcctccggtgttgatgcaaaggccatcctgtcagcaagactcagcaaaagcaggcggctcgaaaacctcatcgcccagcttcccggtgaaaagaagaacgggctctttggtaatctcatcgcattgagccttggtcttactccaaacttcaagagcaattttgatctggcagaggatgctaaactgcaactctcaaaggacacatatgacgatgaccttgacaatctgttggcccagatcggggaccaatatgcagacctcttcctggccgcaaagaatctgtcagatgcaatcctcttgtccgacatactgagagttaacactgagatcacaaaggcacctctgtccgcctccatgattaagagatacgatgagcatcaccaggatctgactttgctcaaagccctcgttagacagcagttgccagaaaagtacaaagaaatattctttgatcaatcaaaaaacggatatgcagggtacatcgacggtggggcaagccaggaagagttctacaaattcatcaaacctatcctggaaaagatggatgggacagaagagctgctggttaagctgaatagggaagacctcctcagaaagcagaggacatttgataacgggagcatccctcatcaaatccacctcggtgaactccatgctatcctgagaaggcaggaagacttttatccatttttgaaggacaatagggagaaaatcgaaaaaatcctgacattcagaatcccatactacgttggtcctctggcaagaggtaacagtaggttcgcatggatgacaaggaaaagcgaggagacaatcacaccctggaattttgaggaagttgttgacaagggtgccagcgcacaatcctttatcgaaagaatgacaaatttcgacaagaatctgcctaacgaaaaggttctcccaaagcattcactcctgtacgaatattttacagtttataacgaactgactaaagttaaatacgttaccgagggtatgaggaagccagcattcctttccggggaacagaagaaagctattgtggacctcctgttcaagacaaatagaaaagtgacagttaagcaactcaaagaggattacttcaaaaagatcgaatgttttgactctgtggagatcagcggggtggaggatagattcaacgccagcctgggtacatatcatgatctcctgaaaatcattaaagacaaggacttccttgacaacgaggagaacgaggacattctggaagacattgttctgaccctcacactctttgaggatagggagatgattgaggaaagactgaagacctacgcccacctctttgacgataaagtgatgaaacagctcaagagaagaaggtatacaggttgggggagactgagcaggaagttgatcaatgggattagggacaaacagtccgggaaaacaatcctcgattttctgaagtcagacggtttcgcaaacagaaattttatgcagctcattcacgatgacagcttgacattcaaggaagacatccaaaaggctcaagtgagcggccaaggggatagcctccacgagcatattgcaaatctggcaggttcaccagccatcaaaaagggcatacttcagacagttaaggttgtggacgaattggttaaagttatgggcaggcataagccagagaatatcgttatcgaaatggcaagggagaaccaaacaactcaaaaagggcagaaaaatagcagagagaggatgaaaagaatcgaggaagggatcaaggaacttgggtcccaaatcctcaaggagcacccagttgaaaatactcaactgcaaaacgagaagctctatctctactatctccaaaacgggagggatatgtatgttgaccaggagctggatattaacagactgtcagattatgatgttgatcatatcgtgccccagtcattcctgaaggacgattccatcgacaacaaagttctcacaaggtccgataaaaacaggggcaagtccgataacgttccaagcgaagaagtggtgaaaaagatgaaaaactattggagacaacttctgaatgcaaagttgattactcagagaaagtttgacaacctcacaaaagcagaaagaggcgggcttagcgaactcgataaggcagggtttatcaaaagacagctggttgagacaaggcagatcacaaaacatgtggcacagatccttgactcaaggatgaataccaagtatgatgagaatgataagttgatcagggaggttaaagttatcacactcaaatccaaactggtgtcagacttcaggaaagactttcaattttataaggtgagggagatcaataactaccaccatgcacatgacgcctacctgaacgcagtggtgggtacagcattgattaaaaaataccctaagctggagtctgagtttgtgtacggggactacaaggtgtacgacgtgaggaaaatgatagccaagtccgagcaggagatcgggaaagcaacagctaagtatttcttttacagtaatatcatgaatttctttaaaactgagattactctggcaaacggggagatcaggaaaagacccctcatcgagactaatggtgaaacaggtgagatcgtttgggacaaggggagggattttgctactgttagaaaagttctgagtatgccacaagtgaatattgtgaaaaagacagaagttcagacaggtgggttctccaaagaatccatcctgcccaagagaaattcagacaagctcatcgcaagaaagaaggactgggaccctaagaagtacggaggatttgacagccccaccgtggcctattccgtgcttgttgtggcaaaggtggagaaagggaagagcaaaaaactgaaatccgtgaaagaactgctgggaattaccatcatggaaagaagctcctttgagaagaacccaatcgacttcctggaagcaaaaggatataaggaagtgaaaaaggacctcattatcaagctcccaaaatactcacttttcgagttggagaacggtagaaagaggatgctggcaagcgcaggggaacttcagaaaggcaatgagctggcattgccatcaaagtatgtgaacttcctctacttggccagccattacgagaaacttaaaggtagcccagaagataacgagcaaaaacagctctttgtggaacagcataagcattatctggatgagatcatagaacaaatctcagagttttccaagagagttatcctcgcagatgcaaacctggataaggttctctcagcctataataagcatagagacaagccaattagagagcaagcagagaacattatccacttgttcactcttacaaacctgggggcaccagccgccttcaaatatttcgatacaacaatagacagaaagaggtataccagcaccaaagaagttctcgacgccacactgatccatcaatcaatcacaggcctttacgaaactaggatcgacttgtcacaactgggtggggat

SEQ ID NO: 11 - DNA, 3307 bp, Unknown
  Cas9 nt sequence
gagcaaggacacctacgacgacgacttggacaacctattggcccagataggtgaccagtatgcagacctcttccttgcggccaagaacttgagtgacgctatactgctcagtgacatcctgagggtgaacactgagatcactaaggcccctctctctgcctcaatgattaagcgttacgacgagcatcaccaggatctcaccctgcttaaggcccttgttcggcagcagctccctgagaagtacaaggagatattttttgaccagtctaagaacggctacgccggttacattgacggtggggcaagccaggaggagttctacaagttcatcaagccgatccttgagaagatggacggcaccgaggagctacttgtcaagttgaaccgggaagacctgctccggaaacagcgtacattcgacaacggcagcatccctcaccagatccacctgggcgaactacacgccatcctccgacgtcaggaggacttctatccattcttgaaagataacagggaaaaaatcgaaaaaatacttacgtttcgaataccttactacgtggggccccttgctcggggaaactccagattcgcatggatgaccaggaagtcagaggagaccatcacaccctggaactttgaggaggtggttgacaaaggtgcttctgcccagtccttcattgagcggatgactaacttcgacaagaacctgcccaacgagaaggtgctgccaaagcacagcctgctctacgaatactttactgtgtacaatgagctgacgaaggtgaagtacgtgacagaggggatgcggaagcccgctttcctgagcggcgagcaaaaaaaagcaatcgtggacctactgttcaagaccaaccgaaaggtgacagtgaagcagctcaaggaggactacttcaaaaaaatcgagtgcttcgactctgttgagataagcggcgtggaggaccgattcaacgcctcattgggaacctatcacgacctgctcaagatcattaaggacaaggacttcctggataatgaggagaatgaggacatcctggaggatattgtgctgacccttactctattcgaggacagggagatgatcgaggagcgactcaagacctacgctcacctgttcgacgacaaggttatgaagcaattgaagcgtaggcgatacacggggtggggaagactctcccgaaaactgataaacggcatcagggacaagcagtcagggaagacgatcttggacttcctgaaatccgacgggttcgccaaccgcaacttcatgcagctcattcacgacgactcactaacgttcaaagaggacattcagaaggctcaagtcagtggacaaggcgactccctgcacgagcacattgcaaaccttgcgggctccccggcgattaaaaagggcattctccaaacggttaaggtggtggacgagctggtgaaggtgatgggccgacacaagcctgagaacatcgtgatcgagatggccagggagaaccagactacccagaagggtcagaagaactctcgggaacgtatgaagcgtattgaggaggggattaaggagttgggctctcaaatcctcaaggagcaccctgtggagaacactcagctccaaaacgagaagctgtacctgtactacctgcaaaacgggcgcgatatgtacgtggatcaggagttggacatcaacaggcttagcgattacgacgtggaccacatcgtgccacagtcattcttaaaggacgacagcatcgacaacaaggttctgacgaggagcgacaagaatcgagggaaaagtgacaatgttccatccgaggaggtggtcaagaaaatgaagaactattggcgtcagcttctgaacgccaagctcatcacccagcggaaattcgacaacctgactaaggctgagcgaggcggactctccgagcttgacaaggctggcttcatcaagcggcagttggtcgaaacccgacagataacgaagcacgttgcccagatacttgactcccgtatgaacaccaagtacgacgagaacgacaagctcatcagggaggtgaaggtcattacccttaagtccaaactcgtcagcgactttcgtaaggacttccagttctacaaggtgcgcgagatcaataactaccaccacgcacacgacgcctacctgaacgcagtggttggaaccgcgttgattaaaaagtaccccaagttggagtcggagttcgtttacggggactacaaggtgtacgacgttcggaagatgatcgccaagtctgaacaggagatcgggaaagcaaccgccaagtatttcttctatagcaacatcatgaacttctttaaaaccgagatcacacttgccaatggcgagatccgtaagaggccgctgatcgagacaaatggggagactggcgagatcgtgtgggacaagggccgcgacttcgcaaccgttcggaaagtcttgtccatgcctcaagtcaacatcgtcaagaagactgaggtgcaaacaggcgggttctcgaaggagtccatactgcccaagaggaactcagacaagctcatagcacgcaaaaaagactgggatccaaagaaatacggcgggttcgactcgccgacagtcgcatactccgtgttagtggtggctaaagtggaaaaggggaagtccaagaagctcaagtccgtcaaggagttgctcgggatcaccattatggaacggtcctcattcgagaagaatcccattgacttcctagaggcgaagggctacaaagaggtcaaaaaggacctaattattaagctccccaagtattcactcttcgaacttgaaaatggtcgtaagcggatgttggcaagcgctggagagcttcagaaggggaacgagcttgcactgccttccaagtacgtgaacttcctgtacctcgcctctcattacgagaagttgaagggctcaccggaggacaacgagcagaagcagttgttcgtggagcagcacaagcactacctcgacgagatcattgagcagataagtgagttcagcaaacgggtgatccttgccgacgctaacctggacaaggtgctgagcgcctacaacaagcacagagacaagccgatccgagagcaagcggagaacatcatacacctgttcaccctcacgaacctcggggctcccgcagccttcaaatattttgacacgaccatcgaccgtaaacgctacactagcacgaaggaggtgctggacgctacccttatccaccagtccatcaccggcctgtacgagacgagaatcgacttgtcgcagctcggtggtgac

SEQ ID NO: 12 - DNA, 4101 bp, Unknown
  Cas9 nt sequence
gacaaaaaatactcaattggtctggcaattgggaccaacagtgtcggatgggccgtgattaccgacgagtacaaggtgccgtccaaaaaattcaaggtgcttgggaacaccgaccgccactcgatcaagaaaaacctaatcggtgcgttgcttttcgacagtggggagaccgccgaggcaacacgcttaaaacgcacagctaggaggagatatacacggcgcaagaaccgaatatgctacttacaggagatattctccaatgagatggcgaaggtggacgactctttcttccatcggcttgaggaatccttcctggtcgaggaggacaagaagcacgagcgacacccgatattcgggaacatcgttgatgaggtggcgtaccacgagaagtacccaacgatataccacttacgcaagaagctcgtggactctacggacaaggccgacttgcgccttatctacttggcactggcccacatgattaagttccgaggccacttccttatcgagggtgacctgaaccccgataactccgacgtggacaagctcttcatccaactcgtccagacatacaaccagctattcgaggagaatcctatcaacgcctctggggtggacgctaaagctatcctctcagcccgcctgtcaaagtcgaggaggttggagaacctaatcgcccagcttccaggcgagaagaaaaatgggctgttcggaaaccttatcgcactctcactgggcctaaccccgaacttcaagtccaacttcgacctggcagaggacgcgaaattgcagttgtcgaaagacacctatgacgatgacctggacaacctgttggcccagataggggaccagtacgccgacctgttcctagcggccaagaacctgtccgacgccatcttgctgtcggatatactgcgggtgaacaccgagatcactaaagcacctctctccgccagcatgattaagcgttacgacgagcaccaccaagatttgaccctgctaaaggcacttgtacggcagcagcttcccgagaagtacaaggagatctttttcgaccaaagcaagaacggctacgccgggtacatcgacggaggtgccagccaggaggagttctacaagttcattaagcccatcctggagaagatggacgggactgaggaactacttgtgaagctgaaccgggaagacttactacggaagcagcgtaccttcgacaacggttctatcccacatcagatccatcttggggagttgcacgcgatcctgcgacgccaggaggacttttaccccttcctgaaagacaaccgcgagaaaatcgagaagatactgaccttcagaataccttactacgtcggaccccttgcgcgaggcaactcaagattcgcgtggatgaccaggaaatcagaggagaccatcacaccctggaatttcgaggaggtggttgacaagggtgcctccgcccagtcctttatcgaacgaatgaccaacttcgacaagaacttgcccaacgagaaggtgctccccaaacacagcctcctctacgaatatttcacagtgtacaacgagcttactaaagttaagtatgttactgagggcatgaggaaacccgccttcctgtcaggcgagcagaagaaagctattgtggacctccttttcaagaccaaccggaaggtgacagtgaagcagctcaaggaggactacttcaagaagatagagtgcttcgacagcgtggagatcagcggggtggaggacagattcaatgcctctctcggaacataccacgacttgcttaagatcatcaaggacaaggacttcctcgacaacgaggaaaacgaggatattctggaggatattgttctgactcttaccctgttcgaggaccgggagatgatcgaggagcgtctcaagacctacgcccacctgttcgacgacaaagttatgaagcagctcaagcgtcggagatataccggatggggccgtctgtctcggaagctcatcaacgggatcagggacaagcagtcagggaagacgatcttagacttccttaagtctgacggcttcgccaacaggaacttcatgcagttgatccacgacgacagccttaccttcaaggaggacatccagaaggcccaagtgagtggccagggtgacagcctccacgagcatattgctaatcttgcgggttccccagcgattaaaaagggcatacttcaaaccgttaaggtggtggacgagcttgtcaaggtgatggggcgacacaagcccgagaacatcgtgatcgagatggccagggagaaccagaccacccagaaggggcagaagaatagccgagaacgcatgaagcgcatcgaggaggggattaaggagctagggagccagatcctcaaggaacatcccgtcgagaacacccagctccagaacgagaagctatacctctactacttgcaaaacgggagggatatgtacgtggatcaggagttggacattaaccgcctaagcgactacgacgtagatcacatcgtgcctcagtcattcctcaaagacgacagcattgacaacaaagtcttgacccgatccgacaagaaccgaggaaaatccgacaatgtgccctcagaggaggtcgtcaagaaaatgaagaactattggaggcagctacttaacgccaaactcataacccagcggaagttcgacaacctgacaaaggctgagcggggtgggctcagcgagcttgacaaggctggcttcatcaagcggcagttggtggagacaagacagataacgaagcacgtggctcagatcctggactctcgcatgaacacgaagtacgacgagaacgacaaattgatccgcgaggtcaaggttattacgctcaagagcaaacttgtcagcgatttccgcaaggacttccagttctacaaggtgagggagattaacaactaccaccatgcacatgatgcctacttgaacgcagtggtggggaccgcgcttattaaaaagtaccctaagttggagtcagagttcgtttatggggactacaaggtgtacgacgtccggaagatgattgcaaagtctgaacaggaaatcgggaaggccaccgccaaatatttcttctacagtaacattatgaatttttttaagactgaaattactctcgcaaacggcgagatcaggaagcgtcccctcatcgagacaaacggggagaccggggagatagtctgggacaaggggcgggacttcgctacggtgaggaaggtgctctcgatgccacaagtgaacatcgtcaaaaagacagaggtgcagaccggtggcttctcaaaggagtcaatcctgccaaaacgtaacagcgacaagctcatcgcccgcaagaaagactgggaccctaagaagtatggtgggttcgactcaccgacggtcgcatactccgttctggtcgtggcaaaggtggaaaagggcaagtccaaaaaactgaaatccgtgaaggagttgcttggcattaccatcatggaacgcagcagcttcgagaagaaccccattgacttcctggaggctaaagggtacaaggaggtcaagaaagatttaattattaagctacctaagtacagcttgttcgagctggagaacggccgaaaacgaatgctcgcatccgccggggaacttcaaaagggcaacgagcttgcgctgccctccaagtacgtgaacttcctgtacttggcatcccactacgagaaactcaagggtagcccagaggacaacgagcagaagcagctattcgtggagcagcacaagcactacctcgacgagataatcgagcagatcagtgagttcagtaagcgggtgatactcgcggacgccaacttggacaaggtgcttagtgcctacaacaagcaccgtgacaagcccatccgagaacaggctgagaacatcatccaccttttcactctgacaaacctcggtgctcccgccgccttcaaatacttcgacactaccatcgacaggaagcgctacacatctacgaaggaagttcttgacgctacgcttattcatcagtctatcacagggctgtacgagacaaggatcgaccttagccaactcggcggggat

SEQ ID NO: 13 - DNA, 4101 bp, Unknown
  Cas9 nt sequence
gacaagaagtacagcatcgggctggcgatcgggaccaactccgtcggctgggctgtgattaccgacgagtacaaggtgccatccaagaagttcaaggtcctcggcaacactgaccggcacagcattaagaagaacctgattggggcgctgctgttcgattcgggggagactgcggaggcgaccaggctgaagcggactgcgcgccggaggtacaccaggaggaagaatcggatctgctacctccaggagattttctcgaatgagatggccaaggtggacgattccttcttccatcgcctggaggagtcgttcctcgttgaggaggacaagaagcatgagaggcatcccattttcgggaatatcgttgacgaggtggcttaccatgagaagtacccgaccatctaccatctgcggaagaagctcgtcgattcgaccgataaggccgacctgcggctgatctacctggccctcgcgcacatgattaagttccggggccatttcctcatcgagggcgacctcaacccggacaactcggacgtggataagctcttcattcagctcgtgcagacatacaaccagctcttcgaggagaatcccattaacgcctcgggggtcgacgctaaggctattctctcggctcggctgtcgaagtcgcgccggctggagaatctcattgcccagctcccaggcgagaagaagaacggcctcttcggcaacctgattgccctgtcgctggggctcacaccgaatttcaagtcgaacttcgacctcgccgaggacgctaagctccagctcagcaaggatacttacgatgatgacctcgataacctgctcgcccagattggggatcagtacgcggatctgttcctcgcggccaagaatctcagcgatgctattctcctgtcggacattctccgcgtcaacacagagattactaaggccccactgtcggcgagcatgattaagaggtacgatgagcatcatcaggacctgacactgctcaaggcgctggtccggcagcagctccccgagaagtacaaggagattttcttcgatcagtcaaagaatgggtacgcgggctacattgatggcggcgcgtcccaggaggagttctacaagttcattaagcccatcctggagaagatggacgggaccgaggagctgctggtgaagctcaatcgggaggacctgctccggaagcagcgcacattcgacaatggctcgattcctcaccagattcacctgggcgagctgcacgccattctccgcaggcaggaggacttctacccgttcctcaaggacaaccgcgagaagatcgagaagatcctgaccttccggattccatactacgtggggccgctcgcgcgggggaactcccggttcgcgtggatgactcgcaagtccgaagaaacgattacaccgtggaatttcgaggaggtcgtcgacaagggcgctagtgcgcagtcattcattgagaggatgaccaatttcgataagaacctgcctaacgagaaggtgctgccgaagcattcgctgctctacgagtacttcaccgtttacaatgagctgaccaaggtgaagtatgtgactgagggcatgaggaagccagcgttcctgagcggcgagcagaagaaggctatcgtggacctgctcttcaagactaaccggaaggtgactgtgaagcagctcaaggaggactacttcaagaagattgagtgcttcgattccgttgagattagcggggtggaggatcggttcaatgcttcgctcgggacataccacgatctcctgaagatcattaaggataaggacttcctcgacaacgaggagaacgaggacattctcgaagatattgtcctgaccctcaccctcttcgaggatcgggagatgatcgaggagaggctcaagacatacgctcatctgttcgatgataaggtcatgaagcagctgaagcgcaggcggtacacagggtgggggcggctgagccggaagctgatcaacgggattcgggataagcagtccgggaagacaattctcgacttcctcaagtccgacgggttcgctaaccggaacttcatgcagctcattcatgatgactcgctgacattcaaggaggatattcagaaggcgcaggtttcggggcagggcgactcgctccacgagcatattgcgaatctggcgggctcccccgcgattaagaagggcattctgcaaaccgtcaaggtggttgatgagctggtcaaggtcatggggcggcataagccagagaatattgtcatcgagatggcgcgggagaatcagaccacacagaaggggcagaagaactcacgggagcggatgaagcgcatcgaggagggcatcaaggagctggggtcgcagatcctgaaggagcatcccgtggagaacactcagctgcaaaatgagaagctgtacctctactacctccagaacgggagggacatgtatgtggatcaggagctggatattaataggctgagcgattacgatgtcgaccacattgtcccacagtcgttcctgaaggacgacagcattgacaacaaggtgctgacccgctcggataagaacaggggcaagagcgataatgttccaagcgaggaggttgtgaagaagatgaagaactactggcggcagctcctgaacgcgaagctcatcacacagcggaagttcgacaacctcaccaaggctgagcgcgggggcctgagcgagctggacaaggcggggttcattaagaggcagctggtcgagacacggcagattacaaagcatgttgcgcagattctcgattcccggatgaacaccaagtacgatgagaacgataagctgattcgggaggtcaaggtaattaccctgaagtccaagctggtgtccgacttcaggaaggacttccagttctacaaggttcgggagatcaacaactaccaccacgcgcatgatgcctacctcaacgcggtcgtggggaccgctctcatcaagaagtacccaaagctggagtcagagttcgtctacggggattacaaggtttacgacgtgcggaagatgatcgctaagagcgagcaggagattggcaaggctaccgctaagtacttcttctactccaacatcatgaacttcttcaagacagagattaccctcgcgaatggcgagatccggaagaggcccctcatcgagacaaatggggagacaggggagattgtctgggataaggggcgggatttcgcgaccgtccggaaggtcctgtcgatgccccaggttaatattgtcaagaagactgaggtccagactggcggcttctcaaaggagtcgattctcccaaagaggaactccgataagctcattgctcggaagaaggattgggaccccaagaagtacgggggattcgactcccccactgttgcttactctgttctggttgttgctaaggtggagaaggggaagtcgaagaagctgaagagcgtgaaggagctgctcgggattacaattatggagaggtcatccttcgagaagaatcccatcgacttcctggaggccaagggctacaaggaggtgaagaaggacctgattattaagctgcccaagtactcgctcttcgagctggagaatgggcggaagcggatgctggcgtccgcgggggagctgcaaaaggggaacgagctggcgctcccctccaagtatgtgaacttcctctacctggcgtcgcactacgagaagctgaaggggtccccagaggataatgagcagaagcagctcttcgtcgagcagcataagcactacctggacgagattatcgagcagattagcgagttctcgaagcgggtcatcctcgcggatgcgaacctggataaggtgctcagcgcctacaataagcaccgggacaagccgattcgggagcaggcggagaatattattcacctcttcacactcaccaacctcggggcaccagctgcgttcaagtacttcgacactactatcgaccggaagcggtacacctcgacgaaggaggtgctcgacgccaccctcattcaccagtcgatcacaggcctgtacgagacacggattgacctgtcccagctcgggggcgac

SEQ ID NO: 14 - protein, 1367 aa, Artificial sequence
  nCas9
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 15 - protein, 1367 aa, Artificial sequence
  enCas9
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 16 - protein, 1228 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 17 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 18 - protein, 1241 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 19 - protein, 1238 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 20 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 21 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 22 - protein, 1206 aa, Unknown
  Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 23 - protein, 1233 aa, Unknown
  Lachnospiraceae bacterium
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 24 - protein, 1227 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 25 - protein, 1264 aa, Leptospira inadai
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 26 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 27 - protein, 1352 aa, Unknown
  Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 28 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 29 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 30 - protein, 1484 aa, Unknown
  Peregrinibacteria bacterium
  MISC_FEATURE (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 31 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 32 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 33 - DNA, 3987 bp, Artificial sequence
  Cas12a polynucleotide
atggccgggagcaagaagcgccggataaagcaggacacgcagttcgagggcttcaccaacctgtaccaagtctccaagacgctccggttcgagcttatcccgcaagggaagaccctgaaacacatccaggaacaaggtttcatcgaggaggacaaggcccgcaacgaccactacaaggagctcaagcccataatcgatcggatctacaagacgtacgccgaccagtgcctccaactggtgcagctcgactgggagaacctgagcgccgccattgacagctaccgcaaggaaaagacggaggagacgcgcaacgcccttattgaggagcaagccacctaccgcaacgccatccacgactacttcatcgggcgcaccgacaacctgacggacgcgatcaacaagcgccacgcggaaatctacaagggccttttcaaggccgagctcttcaacgggaaggtcctaaaacagctcgggactgtcacgacaaccgagcatgagaacgccctccttcgcagcttcgacaagttcaccacatacttctcgggcttctaccggaaccgcaagaacgttttcagcgccgaggacatctccaccgccatcccgcacaggatcgtccaggacaacttccccaagttcaaggagaactgccacatcttcacgcgcctgattacagccgtaccttcacttcgtgagcacttcgagaacgtcaaaaaggccatcgggatcttcgtctccacgtccatcgaggaggtattctctttcccgttctataaccagctcctgacccagacgcagatcgacctctacaaccagctactgggcggcatcagccgggaggccgggaccgagaaaataaagggcctcaacgaagttctcaacctggccatccagaagaacgacgagaccgcgcatatcatcgcatccctgccgcatcgcttcattcctttgttcaagcagatattgagcgaccggaacaccctctcgttcatcctcgaagaattcaagagcgacgaggaggtcattcagtctttctgcaagtacaagacgctcctacggaatgagaatgtgctggagaccgcggaggcactcttcaatgagctgaactccattgacctgacccacatcttcattagccacaagaaactggagacgatctccagcgccctgtgcgaccactgggacactctccgcaacgccctctacgaacgccggatctccgaacttaccggcaagataactaagtcggctaaggagaaggtgcaacggagcctcaagcacgaggacatcaaccttcaggaaatcatctcagccgcgggcaaggagctgagcgaggcgtttaagcagaaaacatcggagatactgagccacgcgcacgcggccctggatcaaccgctgccgacgactctcaagaagcaagaggagaaggaaatccttaagtcccagctcgactcgctgctcggcctctatcacttgctcgactggttcgcggttgatgagtccaacgaggtggacccggagttctccgcgcgcctcacgggtattaagctggagatggagccaagcttaagcttctacaacaaggcccgcaactacgcgaccaaaaaaccgtactcagtcgagaaattcaagctgaatttccagatgcctacattggcgagggggtgggacgtgaaccgcgagaagaacaatggagccatcctgttcgtcaaaaatgggttgtactacctgggcatcatgcccaagcagaagggccgttacaaggccctgtcattcgagcctaccgagaagacctcggagggcttcgacaagatgtactacgactatttcccggacgccgccaagatgatcccgaagtgctccacgcagctcaaagccgtcacggcccacttccagacgcataccacgccgatacttctgagcaacaacttcattgagccgctagagatcacgaaggagatatacgacctaaacaaccccgaaaaggagcccaagaagttccagacagcctacgctaagaagacaggtgatcagaagggatatagggaggcactctgcaagtggatcgacttcacgcgcgacttcctgtcgaaatatacaaagacgaccagcattgacctaagttctctccgcccatcctcccagtacaaggatctgggcgagtattatgcggagctgaacccattgctgtaccacatcagcttccagaggatcgccgagaaggagattatggacgcggtggagacggggaaactatacctgttccaaatatataacaaggacttcgctaaagggcaccacgggaagcccaacctgcacacactctactggacgggcttgttttcgccagaaaatttggccaagacttcgatcaagctcaacggccaggcggagttgttttaccgtcccaagtctcgcatgaagcgcatggcgcatcgcctcggagagaaaatgcttaacaagaagctcaaggatcagaagacgcccatacctgatacgttgtaccaggaattgtacgactacgtgaaccaccgcctatcgcacgacctctcagacgaggcccgcgccctcctcccaaacgtgattactaaggaggtttcccatgaaataatcaaggaccgacggttcaccagcgacaaattttttttccacgtgcctatcacgctcaattaccaggcggccaactccccatcgaagttcaaccagcgcgtgaacgcctaccttaaggagcacccggagaccccaatcatcgggatcgaccgtggcgagcggaacctgatctatattacggtgatcgatagcaccgggaagatcctggagcagcgctccctgaacacaatccagcagtttgactaccagaagaaactcgacaaccgggagaaggagcgcgtcgcagcccggcaagcatggagtgtggtcggcaccataaaggacctgaaacagggttacctaagtcaagttatccacgagatcgttgacctgatgatacactatcaagccgtagtcgtgctggagaacctcaacttcgggtttaagtccaagcgcaccggcatcgcggagaaggcggtgtaccagcagttcgagaagatgctgatcgacaagctgaactgcctggtgctcaaggactaccctgcggagaaggtcggcggggtcttgaacccgtaccagctaaccgaccagttcacgagcttcgccaaaatgggcacgcagtccggattcttgttttatgtcccggctccatatacaagtaagatcgacccgctgacagggtttgttgacccattcgtgtggaagaccatcaagaaccacgagagcaggaaacacttcttagagggcttcgacttcctgcattacgacgttaagacaggcgacttcatcctgcacttcaagatgaaccgcaacctgtcgttccagaggggcctgcccggcttcatgcccgcctgggatatcgtctttgagaagaatgagacgcagttcgacgcgaaggggacgccgttcatcgctggaaagcggatcgtgccggtcatcgagaaccaccgcttcacgggtcgctaccgagatttataccccgccaacgaactaattgcgctgctggaggagaaggggatcgtgttccgagatggcagcaacattctcccgaagctgctggagaacgacgactcgcacgctattgacacgatggtcgccctcatacggagcgtgcttcagatgcggaacagtaacgctgccacgggcgaggactacattaactcccccgtccgcgacctcaacggggtctgcttcgatagccgcttccagaacccggagtggcctatggatgcggacgcgaacggggcctaccacatcgccctcaagggccaactcctgctcaaccacttgaaggaaagcaaagacctcaaattgcagaatggcatcagtaaccaggactggctcgcgtacatccaggaactgagaaacgggtccaagaagcggcgtatcaagcaagattga

SEQ ID NO: 34 - DNA, 3987 bp, Artificial sequence
  Cas12a polynucleotide
atggcgggaagcaaaaagcgccggattaagcaagacacgcagttcgagggcttcacgaacctctaccaagtcagcaagaccctccggttcgagctgataccacagggaaagacgctcaagcacatccaggaacagggcttcatcgaggaggacaaggcgcgcaacgaccactacaaggagttgaaaccgatcatcgaccgcatctacaagacgtacgccgaccagtgcctccagctcgtgcagctcgactgggagaacctctccgccgccattgactcgtaccggaaggagaagactgaggagacccgcaacgccctgatcgaggagcaagcaacctaccggaacgccatccacgactacttcatcggccgcaccgacaacctcaccgacgcgatcaacaagcggcacgcggagatatacaaagggctgttcaaggcggagctgttcaacggcaaggtgctcaagcagctagggacggtgaccacgaccgagcacgagaacgcgctcctccgcagcttcgacaagttcaccacctacttcagcggcttctaccggaaccgcaagaatgtgttcagcgcggaggacatcagcacggccatcccgcaccgcatcgtccaggacaacttcccgaagttcaaggagaactgccacatcttcacccgcctgataaccgccgtcccctccctgcgggagcacttcgagaacgtcaaaaaggcaattgggatcttcgtctcgaccagcattgaggaggtgttcagcttccccttctacaaccagctcctcacccagacgcagatcgacctgtacaatcagttgctcggcgggataagccgcgaggcgggaaccgaaaaaatcaaggggctgaacgaagtgttgaacctcgccatccagaagaacgacgagaccgcgcacatcatcgcctccctgccccaccggttcatcccgctgttcaagcagatcctctctgaccggaacaccctgtccttcattcttgaggagttcaagtcggacgaggaggtcatccagagcttctgcaagtacaagacgctgctacggaacgagaacgtgctggagacggcggaggcactgttcaacgagctaaacagcatcgacctcacgcacatcttcatcagtcacaagaaactggagaccatctcctccgcgctgtgcgaccactgggacacgctcaggaacgcgctctacgagcgccgaatcagtgagctgacgggcaagatcacgaagtccgcgaaggagaaggtgcagcggtccctcaagcacgaggacatcaacctccaggagatcatctcagcggctgggaaagagctgtccgaggcgttcaagcagaaaacgagcgaaatcctgtcccacgcgcacgcggccctggatcagcctctgccgacgaccctcaagaaacaagaagaaaaggaaatcctcaagtcgcagctcgactcgctgctgggcctgtaccatctcctcgactggttcgccgtggacgagagcaacgaggtggaccccgagttctccgcgcggcttacggggatcaagctggagatggagcccagcctgtccttctacaacaaggcgcgcaactacgccaccaagaagccctacagcgtggagaagttcaagctcaacttccagatgcccactctcgcacgtgggtgggacgtcaaccgcgaaaaaaataatggggcgatcctgttcgtcaagaacggcctgtactacttgggcatcatgccgaaacagaagggccgctacaaggccctgagcttcgaaccgaccgagaaaacgagcgaggggttcgacaagatgtactacgactacttccccgacgccgcgaagatgattccaaagtgctccacgcagcttaaggccgtgacggcccacttccagacgcacacgaccccgatcctcctcagcaacaacttcatcgagcccctggagatcacgaaggagatatacgacctgaacaacccggagaaggagcccaagaaattccagaccgcctacgccaagaagacaggcgaccaaaagggttacagggaggccctctgcaagtggatcgacttcactagggacttcctgtccaagtacaccaagactacctctatcgacctgtccagcctccgcccgtcgtcccagtacaaagatttgggcgagtattacgcggagctgaacccactgctctaccacatcagcttccagcgcatcgcggagaaggagatcatggacgcagtggagacgggcaagctatacctatttcagatatacaacaaagacttcgctaagggacaccacggcaagcctaacctgcacaccctctactggacggggctcttcagcccggagaacctcgccaagacctcgatcaagctcaacggccaggccgagctgttctaccggcccaagtcccgcatgaagcggatggcccaccggctcggggagaaaatgctcaacaagaaattgaaggaccaaaaaacgccgatacccgacaccctataccaggagctgtacgactatgtgaaccaccgcctgagccacgacctcagcgacgaggcgcgggccctcctgccgaacgtcatcacaaaggaggtcagccacgagatcatcaaggaccggcgcttcacctccgacaagtttttctttcacgtgcccatcacgctcaactaccaggccgccaactcgccgtccaagttcaaccagcgcgtgaacgcctacctcaaggagcaccccgagaccccgatcatcgggattgaccgaggggagcggaacctcatctacatcaccgtcatcgacagcaccgggaagatccttgaacagcggtcgctcaacaccatccagcagttcgactaccagaagaaactcgacaaccgggagaaggagagagtggcggcccgccaggcttggtccgtcgtcgggacgattaaggacttgaaacaaggttacctgtcgcaagtgatccacgagatcgttgacctgatgatccactaccaagccgtcgtggtcctggagaacctcaacttcggcttcaagagcaaacgaaccggcatcgcggagaaggccgtgtaccagcagttcgaaaaaatgctgatcgacaagctgaactgcctcgtgctcaaggactaccccgctgagaaggtcggcggggtgctgaacccgtaccagctcactgaccagttcaccagcttcgcaaagatgggcacccagtccggcttcctgttctacgtgcctgcgccatacacctcgaagatcgacccgctcaccgggttcgtggaccccttcgtctggaagaccatcaagaaccacgagagccgcaagcacttcctggagggcttcgacttcctccactacgacgtcaagaccggggacttcatcctgcacttcaagatgaaccgcaacctcagtttccagcgcggcctgccggggttcatgcccgcttgggatatagtcttcgagaagaatgagacgcagttcgacgcgaagggcaccccgttcatcgccgggaagcgcatcgtgccggtcatcgagaaccaccggttcaccgggcgctaccgcgacctatacccggcgaacgagttgatcgccctcctggaggagaagggcatcgtgttccgcgacggctccaacatcctcccgaagctgctcgaaaacgacgactcccacgccatcgacacgatggtcgcgctgatccggtcggtgctccagatgcggaactccaacgccgcgacgggcgaggactacatcaacagtccggtccgcgatctgaacggcgtctgcttcgactcccggttccagaaccccgagtggccgatggacgcggacgcgaacggcgcataccacatcgccctaaaagggcaattgctgctcaaccacctcaaggaatccaaagacctaaagctccagaacggcatctccaaccaggactggctggcgtacatccaggaactgcggaacgggagcaaaaaacgtcggatcaagcaagattga

SEQ ID NO: 35 - DNA, 3987 bp, Artificial sequence
  Cas12a polynucleotide
atggcgggctccaagaaacgccggattaagcaagatacccagttcgaggggttcacgaacctctaccaagtgagcaagaccctccgattcgaactgattcctcaggggaagaccctcaagcacatccaggagcaagggttcatcgaggaggacaaggcgcggaacgaccactacaaggaactcaaacccatcatcgaccgcatctacaagacctacgccgatcagtgcctccagctcgtgcagttggactgggagaacctcagcgcggccattgactcctaccggaaggagaaaacggaggagacgcgcaacgcgctcatcgaggaacaggcaacctatcgcaacgccatccacgactacttcatcgggaggactgacaacctcactgacgcgattaacaagcgccacgcggagatatacaagggactcttcaaagcggagctgtttaacggcaaggttctcaagcaactcggcactgtgaccacgaccgagcatgagaacgccctgctccgctccttcgacaagttcaccacctacttctccgggttctaccgcaaccgcaagaatgtcttcagcgcggaggacatcagcacggccattccacatcgaatcgtccaagataacttcccgaagttcaaggagaactgccacatcttcacccgactcattactgctgtaccgtcgttacgcgaacacttcgagaacgtcaagaaggcaattggaatcttcgtctctacgtcaatagaggaggtgttcagcttccctttctacaaccagctccttacgcagacccagatagacctgtacaatcagctcctcggtgggatcagccgggaggcggggactgagaagattaaagggctcaacgaggtcttgaacctggccatccaaaaaaacgatgagacggcgcacatcatcgcctcgctgccccaccggttcatcccgctgttcaagcagatcctcagtgacaggaacaccttgagctttatcctagaggagttcaagagcgacgaggaggtgatccagagcttctgcaagtacaaaaccctgctgaggaacgagaacgtcctggagacggcggaggcgctgttcaacgagctgaactctatcgacttaactcacatattcatctcgcacaagaagctggagactattagctctgcactctgcgaccactgggacaccctccgcaacgcgctctacgagcgccgcatctcggagctgaccgggaagatcaccaaatccgcgaaggaaaaggtccagcgttccctcaaacacgaggatattaacttacaggagattatctcagcggctgggaaggagttgtcagaggcgttcaagcagaaaacttccgagatcctgagccacgcgcacgcagcgctcgaccagcctctgcccaccaccctcaaaaagcaggaagaaaaagagatcctcaagagccagttggactccctgctggggctctatcaccttctcgactggttcgccgtcgatgagtcgaacgaggtggaccccgagttctccgcccggctgaccggcatcaagctagagatggagccgtccctcagcttctacaataaggcccgcaactacgcgaccaaaaaaccctacagcgtggagaagttcaagctgaacttccagatgccgaccttagcacgcggttgggacgtaaacagggagaagaacaatggagccatcctgttcgtcaagaacgggctttactacctcgggataatgcccaagcagaagggccgctacaaggccctttccttcgagccgacggagaaaacctccgaggggttcgacaagatgtactacgactacttccccgacgccgccaagatgatcccgaagtgctcaacgcagctaaaagccgtgaccgcccacttccagacccacacgacgccgatcctgctgagcaacaacttcatcgagccccttgagatcactaaggagatatacgacctgaacaaccccgagaaggagcccaagaagtttcaaaccgcctacgccaaaaaaactggcgaccaaaagggctacagggaggcgctgtgtaagtggatcgacttcacacgcgacttcctttcgaagtatacgaagacaacctctattgacctgagcagcctgcgtcctagctcccagtacaaagatttgggcgagtactacgcggagcttaatccactactctaccacatctcattccagcgcatcgctgagaaggaaatcatggacgcggtggagacaggcaaactgtacctcttccagatatacaacaaagacttcgctaaggggcaccacgggaagcccaaccttcatacgctctactggacgggcctattcagccccgaaaatctggccaagacctccatcaagctgaacggccaagcggagctgttctacagacccaagagccggatgaagcggatggcccacaggctcggcgagaaaatgcttaacaaaaagttgaaggaccagaaaacccctatccccgacaccctctaccaggaactgtacgactacgtgaaccacaggctctcgcacgacctttccgacgaggcccgtgccctactcccgaacgtcattaccaaagaggtttcgcacgagatcatcaaggaccggcggttcacgagcgacaagtttttctttcacgtccccatcacccttaactaccaggcggccaactccccatccaagttcaaccagcgtgtgaatgcctacctcaaggagcacccagagaccccgatcattgggatcgaccggggcgagcggaacctgatctacatcaccgtcatcgactcgacgggcaagattcttgagcagagatcgttgaataccatacagcagttcgactaccagaagaaactcgacaaccgcgagaaggagcgcgtggcggcccgccaggcgtggtccgtcgttgggacgattaaggacttgaaacaaggttatctgtcccaagtcatccacgagatcgttgatctgatgatccactatcaggcagtggtggtgctggagaatctcaacttcggcttcaagagtaagcggacgggaatcgccgagaaggccgtgtaccagcagttcgagaagatgctgatcgacaagctcaactgccttgtgctgaaagactacccggccgagaaggtcggcggcgtcctcaacccgtaccaacttaccgaccagttcacctccttcgccaagatgggcactcagtccgggttcttgttctacgtccccgcaccttacacctctaagatcgaccctctgactggcttcgtagatccattcgtgtggaagaccattaagaaccacgagagccgcaagcacttcctggagggcttcgacttcctgcactacgacgtgaagaccggggacttcatccttcacttcaagatgaaccggaacctcagcttccagcggggcctgccggggttcatgcccgcctgggacatcgtgttcgagaagaacgagacccagttcgacgcgaagggcacgcccttcatcgccgggaagcgtatcgtgccggtgatcgagaaccatcgtttcacgggtcgctaccgtgacctctacccggcgaacgagcttatcgcactcctggaggagaagggcatcgtcttccgggacggctccaacatcctcccgaaactgctggaaaacgacgactctcacgccatcgacacgatggtggccctcatccggtccgtgctccaaatgcggaacagcaacgccgccaccggtgaggactacatcaacagcccggtccgggatctgaacggggtgtgcttcgattcgcggttccagaatcctgagtggccgatggacgcggatgcaaacggggcgtaccacatcgcgctcaagggccagttacttctgaaccaccttaaggagtctaaagatttgaaactccagaacgggatctcgaaccaggactggctggcctacatccaagagttgcggaacggcagcaagaagcggcggattaagcaagattag

SEQ ID NO: 36 - DNA, 19 bp, Artificial sequence
  RNA Spacer
  misc_feature (1)..(19): wherein n is A, C, T or G
nnnnnnnnnnnnnnnnnnn

SEQ ID NO: 37 - DNA, 22 bp, Artificial sequence
  Target strand
  misc_feature (4)..(22): wherein n is A, C, T or G
aaannnnnnnnnnnnnnnnnnn

SEQ ID NO: 38 - DNA, 22 bp, Artificial sequence
  Non-target strand
  misc_feature (4)..(22): wherein n is A, C, T or G
tttnnnnnnnnnnnnnnnnnnn

SEQ ID NO: 39 - protein, 24 aa, Artificial sequence
  GCN4 sequence
EELLSKNYHLENEVARLKKGSGSG

SEQ ID NO: 40 - protein, 241 aa, Artificial sequence
  GCN4 sequence
EEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 41 - protein, 277 aa, Artificial sequence
  ScFv antibody
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 42 - DNA, 66 bp, Saccharomyces bayanus
ttcttgtcgtacttatagatcgctacgttatttcaattttgaaaatctgagtcctgggagtgcgga

SEQ ID NO: 43 - protein, 609 aa, Homo sapiens [sequence omitted]

SEQ ID NO: 44 - protein, 482 aa, Artificial sequence
  polypeptide
MVRSGNKAAWLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISERHSIHWPCRLTIGSNLSIRIAAYKSILQERVKKTTWDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDIWAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAK

SEQ ID NO: 45 - DNA, 10 bp, Methanobacterium thermoautotrophicum
aatttttgga

SEQ ID NO: 46 - protein, 83 aa, Methanobacterium thermoautotrophicum
GSVIDVSSQRVNVQRPLDALGNSLNSPVIIKLKGDREFRGVLKSFDLHMNLVLNDAEELEDGEVTRRLGTVLIRGDNIVYISP

SEQ ID NO: 47 - DNA, 25 bp, Bacteriophage MS2
gcgcacatgaggatcacccatgtgc

SEQ ID NO: 48 - protein, 116 aa, Bacteriophage MS2
MASNFTQFVLVDNGGTGDVTVAPSNFANGIAEISSNSRSQAYKVTCSVRQSSAQNRKYTIKVEVPKGAWRSYLNMELTIPIFATNSDCELIVKAMQGLLKDGNPIPSAIAANSGIY

SEQ ID NO: 49 - DNA, 26 bp, Bacteriophage PP7
ataaggagtttatatggaaaccctta

SEQ ID NO: 50 - protein, 127 aa, Bacteriophage PP7
MSKTIVLSVGEATRTLTEIQSTADRQIFEEKVGPLVGRLRLTASLRQNGAKTAYRVNLKLDQADWDCSTSVCGELPKVRYTQVWSHDVTIVANSTEASRKSLYDLTKSLVATSQVEDLVVNLVPLGR

SEQ ID NO: 51 - DNA, 19 bp, Shigella flexneri
ctgaatgcctgcgagcatc

SEQ ID NO: 52 - protein, 62 aa, Shigella phage
MKSIRCKNCNKLLFKADSFDHIEIRCPRCKRHIIMLNACEHPTEKHCGKREKITHSDETVRY

SEQ ID NO: 53 - DNA, 35 bp, Artificial sequence
  Synthetic BbaJ23119 promoter to drive transcription / translation in gram negative bacteria
ttgacagctagctcagtcctaggtataatgctagc

SEQ ID NO: 54 - DNA, 53 bp, Artificial Sequence
  Synthetic BbaJ23102 promoter to drive transcription / translation in gram negative bacteria
ttgacagctagctcagtcctaggtactgtgctagcgctagcaaagaggagaaa

SEQ ID NO: 55 - DNA, 36 bp, Lachnospiraceae bacterium ND2006
gtttcaaagattaaataatttctactaagtgtagat

SEQ ID NO: 56 - DNA, 21 bp, Lachnospiraceae bacterium ND2006
taatttctactaagtgtagat

SEQ ID NO: 57 - DNA, 48 bp, Phage T7
ctagcataaccccttggggcctctaaacgggtcttgaggggttttttg

SEQ ID NO: 58 - DNA, 532 bp, Agrobacterium tumefaciens
ggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtacc

SEQ ID NO: 59 - DNA, 23 bp, Saccharomyces cereviciae
tttactaaaaacacatgtggata

SEQ ID NO: 60 - DNA, 23 bp, Saccharomyces cereviciae
gcggcttaactgtgccctccatg

SEQ ID NO: 61 - DNA, 23 bp, Nicotiana benthamiana
tgccgttaatttgagagtccaag

SEQ ID NO: 62 - DNA, 23 bp, Nicotiana benthamiana
agttcccaacgaagacctcgagc

SEQ ID NO: 63 - DNA, 23 bp, Arabidopsis thaliana
tatgtcaatggccgtcgacatgt

SEQ ID NO: 64 - DNA, 23 bp, Arabidopsis thaliana
gtgggttgtttggaagacatgtc

SEQ ID NO: 65 - DNA, 5187 bp, Artificial sequence
  Lachnospiraceae bacterium ND2006 (Cas12a), Agrobacterium tumefaciens (VirD2) fusion
atgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatag

SEQ ID NO: 66 - protein, 1728 aa, Artificial sequence
  Lachnospiraceae bacterium ND2006 (Cas12a), Agrobacterium tumefaciens (VirD2) fusion
MSGSKKRRIKQDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQDSGGSSGGSSGSETPGTSESATPESSGGSSGGSMPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRR

SEQ ID NO: 67 - DNA, 636 bp, Artificial sequence
  Agrobacterium tumefaciens, Bacteriophage MS2 (MCP) fusion
atgagcgggtccaagaagcgccgcatcaagcaggacgccagcaatttcactcaattcgtcctggtcgacaacggcggtacgggtgatgtcaccgtagccccctcgaattttgccaatggagtggcggaatggatctccagcaactcgcggtcccaagcgtataaagtgacctgctccgtccgccagtcatcggcccagaagcggaagtacaccatcaaggtcgaggttcccaaagttgcgacgcagaccgtgggcggcgttgaactgccggtggcggcctggcgcagctacctgaacatggaactcaccatcccgatattcgcaacgaactccgactgcgaattgatcgtcaaggcgatgcagggcctcctcaaggatggaaatccgatcccgtccgctattgccgcgaactccggcatttattctgctggtagcaagaagcgtcggatcaaacaggattcgggcggcagcagtggtggctcttcggccagcctcgccagaggcggccctaacgcagtgggccttctgacgacaaacgaatccttcgagaaaaatatcaatgaggtctataaccgcacccgagcggagctggatgcctcatcgcgtgaccgctcgcgcagcgggctttcgaggtaa

SEQ ID NO: 68 - protein, 211 aa, Artificial sequence
  Agrobacterium tumefaciens, Bacteriophage MS2 (MCP) fusion
MSGSKKRRIKQDASNFTQFVLVDNGGTGDVTVAPSNFANGVAEWISSNSRSQAYKVTCSVRQSSAQKRKYTIKVEVPKVATQTVGGVELPVAAWRSYLNMELTIPIFATNSDCELIVKAMQGLLKDGNPIPSAIAANSGIYSAGSKKRRIKQDSGGSSGGSSASLARGGPNAVGLLTTNESFEKNINEVYNRTRAELDASSRDRSRSGLSR

SEQ ID NO: 69 - DNA, 5289 bp, Artificial sequence
  Lachnospiraceae bacterium ND2006 (Cas12a), Agrobacterium tumefaciens fusion
atgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataa

SEQ ID NO: 70 - protein, 1762 aa, Artificial sequence
  Lachnospiraceae bacterium ND2006 (Cas12a), Agrobacterium tumefaciens
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRRSGGSSGGSMSGSKKRRIKQDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQDSGGSSGGSSASLARGGPNAVGLLTTNESFEKNINEVYNRTRAELDASSRDRSRSGLSR

SEQ ID NO: 71 - DNA, 1605 bp, Artificial sequence
  Agrobacterium tumefaciens (Vir), synthetic (SH3), Simian virus 40 (NLS) fusion
atgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtgggggctcctcgggtggcagcatgagcggatcaaaaaaaagaaggatcaagcaagatgcggagtacgtgcgtgctttgtttgatttcaacggcaacgatgaagaagacctgccattcaaaaagggcgacatcctgcgtattcgtgataaaccggaagagcagtggtggaatgcagaggacagcgaaggtaagcgcggtatgatcccggttccgtatgtcgagaagtactccggtagtggggggtcctctggtggaagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatag

SEQ ID NO: 72 - DNA, 23 bp, Glycine max
tgtgtgatgttcgatgttggatt

SEQ ID NO: 73 - DNA, 23 bp, Glycine max
ttgtaaccaacatcccctgatga

SEQ ID NO: 74 - DNA, 23 bp, Glycine max
acacctactcatctggccattgt

SEQ ID NO: 75 - DNA, 96 bp, Artificial sequence
  BE4 Linker Agrobacterium codon optimized nucleotide sequence
tccggtggaagttccggaggttcaagcgggtctgaaacgccgggcaccagcgagtcggcgaccccggaaagcagcggtggttcttccggcggtagc

SEQ ID NO: 76 - protein, 32 aa, Artificial sequence
  BE4 Linker amino acid sequence
SGGSSGGSSGSETPGTSESATPESSGGSSGGS

SEQ ID NO: 77 - DNA, 53 bp, Escherichia coli; identical to SEQ ID NO: 54

SEQ ID NO: 78 - DNA, 129 bp, Escherichia coli
ccaggcatcaaataaaacgaaaggctcagtcgaaagactgggcctttcgttttatctgttgtttgtcggtgaacgctctctactagagtcacactggctcaccttcgggtgggcctttctgcgtttata

SEQ ID NO: 79 - DNA, 10816 bp, Artificial sequence
  pWISE3104 Full plasmid sequence
cggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 80 - DNA, 11289 bp, Artificial sequence
  pWISE3452 Full plasmid sequence
cggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 81 - DNA, 7707 bp, Artificial sequence
  pWISE3592 Full plasmid sequence
accggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtgggggctcctcgggtggcagcatgagcggatcaaaaaaaagaaggatcaagcaagatgcggagtacgtgcgtgctttgtttgatttcaacggcaacgatgaagaagacctgccattcaaaaagggcgacatcctgcgtattcgtgataaaccggaagagcagtggtggaatgcagaggacagcgaaggtaagcgcggtatgatcccggttccgtatgtcgagaagtactccggtagtggggggtcctctggtggaagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgccc

SEQ ID NO: 82 - DNA, 7276 bp, Artificial sequence
  pWISE3108 Full plasmid sequence
gcgcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgagcggatcaaaaaaaagaaggatcaagcaagatgcggagtacgtgcgtgctttgtttgatttcaacggcaacgatgaagaagacctgccattcaaaaagggcgacatcctgcgtattcgtgataaaccggaagagcagtggtggaatgcagaggacagcgaaggtaagcgcggtatgatcccggttccgtatgtcgagaagtactccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgcccc

SEQ ID NO: 83 - DNA, 18916 bp, Artificial sequence
  pWISE3776 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgtgtgatgttcgatgttggatttaatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggttaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattacctaggctggcagcacatcccccgttcgcgagctggcgtaacagcgaagaggcccgggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtggtaccaaaaaatggcgggatctaagaagagaagaattaaacaagattccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggatctaagaagagaagaattaaacaagattgacttaattaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctcgggcccggccgtgacggccacgagcgaactcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 84 - DNA, 18920 bp, Artificial Sequence
  pWISE3777 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatttgtaaccaacatcccctgatgataatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggttggtgtgaaacagatgatttgctgctgtaacaaagtaaattatgtctcgacttttaaggcccctttcattttattagattattttattttaattaatgttcttgtcccattttgcaacagatggatgctactacacccaagtattccaaggccaggtatgatgaaattgtgaaggaagtctcttcctacttgaagaaagtaggatacaaccctgacaagattccttttgttcctatctctggttttgagggagacaacatgattgagaggtccacaaaccttgactggtacaagggtccaactctgcttgatgcacttgaccagattagtgagcccaagaggccctctgacaagcccctcaggcttccccttcaggatgtgtacaagattggaggtattggaactgtgccagtgggacgtgttgagaccggtgtcttgaagcctggaatggtggtgacttttgcaccaactggactgacaactgaagtcaagtctgtggagatgcaccatgaatctcttacagaggcacatcctggtgacaatgtgggattcaatgttaagaatgttgctgttaaggatttgaagcgtggttatgttgcctcaaactcaaaggatgaccctgcaaaggaggctgctaacttcacagcccaagtcatcatcatgaaccaccctggtcagattggaaatggctatgcccctgtcctcgactgccacacttctcacattgctgtcaagtttgctgaactcatgaccaagattgacaggcgatccggcaaagagcttgagaaggagcccaagtttttgaagaacggtgatgctggttttgttaagatgattccaaccaaacccatggttgttgaaactttctccgagtatcctccacttggtaggtttgctgttagggacatgcgtcaaactgttgctgtgggagtcatcaagaacgttgagaagaaggatcctaccggagccaaggtcaccaaggctgcccagaagaagaagtcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaatgaatcgtgcgggctggttcatcagggaatgttggctacaatcaatgttggtttcttttctgtactcttgtgtcttcttttctaggtagcttgtttttcggacaaagtttgaagtctccaccatcatctcgcaactgttgttcccagaactgggttcttgatcgacggtggcaaaattgcttttatttatctgtgttttaatgtgttgtgtttgtcggaacccctgattacatttttgttaagcgcagcgagtttcaggactttgctgcgttgtgttgctttggtttattaaatgtcaactttctatttgtagtgttcaatttttggcttggtttgctttttctttataatttgtgttcaaattttggcttggtttgcttttactataatttgtgttcaaattttgggttggattttttaacgatcggctgtttgctcttcttcctctgttttgatgtgttcgtgactatgcaagaatcttcaattttgctaaaataaacttgctttgacaacatagaatcaaatccgagtgctttaatattcggtggtttgtttttatttttggttttatgaaagttaaaattttaaaagtaaatcgataaggtataattgtggtttttatttatcgagaattttttaagtgaatcgatataatttatttcccctaaaataaaataccaaagaatcgaattcgaactttgtctttaataaaactactaatttaatcattatttgttctgtgtaagcatgagaaataaattctacttatcttttagtttaaaaccaaaacaggttaagaataatttttctaaggccgttatcaaggtcaccaaaaatctattcgatctgaccatatattttcgatacttgtacgattcgcagatgttgattggaaattgcaatgaataaattacaaatgccaaatccgattatgcaatgaatgaattacaagtgcatttatccgttttgaatctgttcatgtctaccaatgggagagatttttttcctgcatctgccatacatatgggaagaccgaaaatactttcctaggctggcagcacatcccccgttcgcgagctggcgtaacagcgaagaggcccgggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtggtaccaaaaaatggcgggatctaagaagagaagaattaaacaagattccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggatctaagaagagaagaattaaacaagattgacttaattaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctcgggcccggccgtgacggccacgagcgaactcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 85 - DNA, 12883 bp, Artificial Sequence
  pWISE3387 Full plasmid sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctaaaagattgacacattgcctatactacattctagcgtaggttaaatttatatcagataatgtgggagaaagagatcagttaccattgcatgacaatagctgaccccagatatgagttgttgaaagaagaaacgagcctgtggcatgacaatgggttaatagttacacaggaaatagagagctagcacaagcaaaagtaaacaaattgtataagaacctcatcctcattaaaacgccctgcattgcagattttctcaaatagttctccaccagatgcatattccattacaatgtctagatgagtcggtgttagaataacctgagtcaaatatcaaagaacattttccatgaatatgattattgtacctctgaacataaaaatatataaatacaaatatataccaacctccttaaacctgataatgttaggatgtcttagagacctgtgattaatgatttctcttttaacattttcatcaatctgtgacacacagcaaatgatagggggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttagacgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatacacctactcatctggccattgttaatttctactaagtgtagatttttttta

SEQ ID NO: 86 - DNA, 12883 bp, Artificial Sequence
  pWISE3388 Full plasmid sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctccctatcatttgctgtgtgtcacagattgatgaaaatgttaaaagagaaatcattaatcacaggtctctaagacatcctaacattatcaggtttaaggaggttggtatatatttgtatttatatatttttatgttcagaggtacaataatcatattcatggaaaatgttctttgatatttgactcaggttattctaacaccgactcatctagacattgtaatggaatatgcatctggtggagaactatttgagaaaatctgcaatgcagggcgttttaatgaggatgaggttcttatacaatttgtttacttttgcttgtgctagctctctatttcctgtgtaactattaacccattgtcatgccacaggctcgtttcttctttcaacaactcatatctggggtcagctattgtcatgcaatggtaactgatctctttctcccacattatctgatataaatttaacctacgctagaatgtagtataggcaatgtgtcaatcttttggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttagacgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatacacctactcatctggccattgttaatttctactaagtgtagatttttttta

SEQ ID NO: 87 - DNA, 13155 bp, Artificial Sequence
  pWISE3352 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatttgtaaccaacatcccctgatgataatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggttggtgtgaaacagatgatttgctgctgtaacaaagtaaattatgtctcgacttttaaggcccctttcattttattagattattttattttaattaatgttcttgtcccattttgcaacagatggatgctactacacccaagtattccaaggccaggtatgatgaaattgtgaaggaagtctcttcctacttgaagaaagtaggatacaaccctgacaagattccttttgttcctatctctggttttgagggagacaacatgattgagaggtccacaaaccttgactggtacaagggtccaactctgcttgatgcacttgaccagattagtgagcccaagaggccctctgacaagcccctcaggcttccccttcaggatgtgtacaagattggaggtattggaactgtgccagtgggacgtgttgagaccggtgtcttgaagcctggaatggtggtgacttttgcaccaactggactgacaactgaagtcaagtctgtggagatgcaccatgaatctcttacagaggcacatcctggtgacaatgtgggattcaatgttaagaatgttgctgttaaggatttgaagcgtggttatgttgcctcaaactcaaaggatgaccctgcaaaggaggctgctaacttcacagcccaagtcatcatcatgaaccaccctggtcagattggaaatggctatgcccctgtcctcgactgccacacttctcacattgctgtcaagtttgctgaactcatgaccaagattgacaggcgatccggcaaagagcttgagaaggagcccaagtttttgaagaacggtgatgctggttttgttaagatgattccaaccaaacccatggttgttgaaactttctccgagtatcctccacttggtaggtttgctgttagggacatgcgtcaaactgttgctgtgggagtcatcaagaacgttgagaagaaggatcctaccggagccaaggtcaccaaggctgcccagaagaagaagtcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaatgaatcgtgcgggctggttcatcagggaatgttggctacaatcaatgttggtttcttttctgtactcttgtgtcttcttttctaggtagcttgtttttcggacaaagtttgaagtctccaccatcatctcgcaactgttgttcccagaactgggttcttgatcgacggtggcaaaattgcttttatttatctgtgttttaatgtgttgtgtttgtcggaacccctgattacatttttgttaagcgcagcgagtttcaggactttgctgcgttgtgttgctttggtttattaaatgtcaactttctatttgtagtgttcaatttttggcttggtttgctttttctttataatttgtgttcaaattttggcttggtttgcttttactataatttgtgttcaaattttgggttggattttttaacgatcggctgtttgctcttcttcctctgttttgatgtgttcgtgactatgcaagaatcttcaattttgctaaaataaacttgctttgacaacatagaatcaaatccgagtgctttaatattcggtggtttgtttttatttttggttttatgaaagttaaaattttaaaagtaaatcgataaggtataattgtggtttttatttatcgagaattttttaagtgaatcgatataatttatttcccctaaaataaaataccaaagaatcgaattcgaactttgtctttaataaaactactaatttaatcattatttgttctgtgtaagcatgagaaataaattctacttatcttttagtttaaaaccaaaacaggttaagaataatttttctaaggccgttatcaaggtcaccaaaaatctattcgatctgaccatatattttcgatacttgtacgattcgcagatgttgattggaaattgcaatgaataaattacaaatgccaaatccgattatgcaatgaatgaattacaagtgcatttatccgttttgaatctgttcatgtctaccaatgggagagatttttttcctgcatctgccatacatatgggaagaccgaaaatactttcctaggctggcagcacatcccccgttcgcgagctggcgtaacagcgaagaggcccgggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 88 - DNA, 13155 bp, Artificial Sequence
  pWISE3358 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatttgtaaccaacatcccctgatgataatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggaaagtattttcggtcttcccatatgtatggcagatgcaggaaaaaaatctctcccattggtagacatgaacagattcaaaacggataaatgcacttgtaattcattcattgcataatcggatttggcatttgtaatttattcattgcaatttccaatcaacatctgcgaatcgtacaagtatcgaaaatatatggtcagatcgaatagatttttggtgaccttgataacggccttagaaaaattattcttaacctgttttggttttaaactaaaagataagtagaatttatttctcatgcttacacagaacaaataatgattaaattagtagttttattaaagacaaagttcgaattcgattctttggtattttattttaggggaaataaattatatcgattcacttaaaaaattctcgataaataaaaaccacaattataccttatcgatttacttttaaaattttaactttcataaaaccaaaaataaaaacaaaccaccgaatattaaagcactcggatttgattctatgttgtcaaagcaagtttattttagcaaaattgaagattcttgcatagtcacgaacacatcaaaacagaggaagaagagcaaacagccgatcgttaaaaaatccaacccaaaatttgaacacaaattatagtaaaagcaaaccaagccaaaatttgaacacaaattataaagaaaaagcaaaccaagccaaaaattgaacactacaaatagaaagttgacatttaataaaccaaagcaacacaacgcagcaaagtcctgaaactcgctgcgcttaacaaaaatgtaatcaggggttccgacaaacacaacacattaaaacacagataaataaaagcaattttgccaccgtcgatcaagaacccagttctgggaacaacagttgcgagatgatggtggagacttcaaactttgtccgaaaaacaagctacctagaaaagaagacacaagagtacagaaaagaaaccaacattgattgtagccaacattccctgatgaaccagcccgcacgattcatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgcacgccgtggaaacagaagacatgaccttaagaggacgaagctcagagccaattaacgtcatcccactcttcttcaatccccacgacgacgaaatcggataagctcgtggatgctgctgcgtcttcagagaaaccgataagggagatttgcgttgactggatttcgagagattggagataagagatgggttctgcacaccattgcagattctgctaacttgcgccattggtccagggttagactcaacatcaccggcaagcttcaagaggtcaaaattcagtaattgagttgccacttcatcagcagcatttgacttcttcttctgggcagccttggtgaccttggctccggtaggatccttcttctcaacgttcttgatgactcccacagcaacagtttgacgcatgtccctaacagcaaacctaccaagtggaggatactcggagaaagtttcaacaaccatgggtttggttggaatcatcttaacaaaaccagcatcaccgttcttcaaaaacttgggctccttctcaagctctttgccggatcgcctgtcaatcttggtcatgagttcagcaaacttgacagcaatgtgagaagtgtggcagtcgaggacaggggcatagccatttccaatctgaccagggtggttcatgatgatgacttgggctgtgaagttagcagcctcctttgcagggtcatcctttgagtttgaggcaacataaccacgcttcaaatccttaacagcaacattcttaacattgaatcccacattgtcaccaggatgtgcctctgtaagagattcatggtgcatctccacagacttgacttcagttgtcagtccagttggtgcaaaagtcaccaccattccaggcttcaagacaccggtctcaacacgtcccactggcacagttccaatacctccaatcttgtacacatcctgaaggggaagcctgaggggcttgtcagagggcctcttgggctcactaatctggtcaagtgcatcaagcagagttggacccttgtaccagtcaaggtttgtggacctctcaatcatgttgtctccctcaaaaccagagataggaacaaaaggaatcttgtcagggttgtatcctactttcttcaagtaggaagagacttccttcacaatttcatcatacctggccttggaatacttgggtgtagtagcatccatctgttgcaaaatgggacaagaacattaattaaaataaaataatctaataaaatgaaaggggccttaaaagtcgagacataatttactttgttacagcagcaaatcatctgtttcacaccaacctaggctggcagcacatcccccgttcgcgagctggcgtaacagcgaagaggcccgggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 89 - DNA, 13151 bp, Artificial Sequence
  pWISE3361 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgtgtgatgttcgatgttggatttaatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggttaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattacctaggctggcagcacatcccccgttcgcgagctggcgtaacagcgaagaggcccgggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 90 - DNA, 13151 bp, Artificial Sequence
  pWISE3362 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgtgtgatgttcgatgttggatttaatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggtaatgacatttgtttcatgtataaacctgcgttgttatttgtaaaaatgggattttaacccgatcgcttttgtttttatctgttaaacggatccgattctgattaatttggggtccagtattggagcagaaaaataccactgaatagtgtttttattttttggtatttggtaatcaaatttatattggagcagaaaaatatcactgaataacttgttttttctttttggtattttttggggtccagtatacaaaaacttgcacaaaaattagggattagtatggcattacatcttttaatgattttcaagttattattgattaggaattttttatgtggatctgtgtggggatcatctcaatgtgctttctgtaagacaaggactacctgaagcagaaagattgcataactaaaattgattaggaatttttatgtggacctgtgtggatcatctaaatgtgcattccgcaagccaattaatgttccaactgaagcagattgcttacataatttatatacgataccaaatatgcttcacgagcataatttttaagttgctacctcttggtaaggggcagctaattgaaactagggatcatgatctccgtttgttcaaaaatcctttggtgtgttttcaaaatatcactttagaatctaatccaagagttctccctacctaataaatatctttaacctataataccaaaatctaataattcgtgggatgatcaccatccttcacacaactcatccctgcttttcctccgtgataagcatgaagaataaaaaacccactaatatacgccaattcactggattgagaacaaaattcaaacacaatatgccagcatacagttgataattatatatcagctccacaaattgataacaaacagtagtaacattaatgggacaatagagttcaacacaaaccaaacttattttcaaaggtcattacagacccattacacatcacatttcttcttaaaatgtctgggaaaatccaacatcagacatcacacagacatcagctccagcttatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgcacgccgtggaaacagaagacatgaccttaagaggacgaagctcagagccaattaacgtcatcccactcttcttcaatccccacgacgacgaaatcggataagctcgtggatgctgctgcgtcttcagagaaaccgataagggagatttgcgttgactggatttcgagagattggagataagagatgggttctgcacaccattgcagattctgctaacttgcgccattggtccagggttagactcaacatcaccggcaagcttcaagaggtcaaaattcagtaattgagttgccacttcatcagcagcatttgaaaaccccccacgaagacgcaacaccaagtgcagagttgactccttctggatgttgtagtcagcgagggtccttccatcctctagctgtttgccagcaaaaataagcctctgctggtccggtgggattccttccttgtcctggatcttcgccttcacattgtcaatggtgtcggagctctccacctcgagggtaatagtcttacccgtaagggtcttgacgaagatctgcataccaccacgaagacgcaacaccaagtggagagttgactccttctggatgttgtagtcagcaagggtacgtccgtcctcgagctgcttgccggcgaagatcagcctctgctggtctggggggataccctccttgtcctggatcttagccttgacgttgtcgatggtgtcggagctctcgacttctagggttatagtcttgccggtgagggtcttaacgaagatctgcatgccaccacggagacggaggacgaggtgaagggttgattccttctggatgttgtagtcggcgagggtgcgcccgtcctcaagttgctttccggcgaagatgagacgttgctggtctggggggattccctccttgtcctggatcttggccttgacgttgtcaatggtgtcagagctttcgacctctagggttatggttttgccagtgagagtcttgacgaagatctgcatgccaccacggagacgaaggacaaggtgaagggttgactccttctggatgttgtagtcggcgagggtacggccgtcctcgagctgctttccggcgaagatgagacgttgctgatccgggggaattccttccttgtcctggatcttggccttgacgttgtcgatggtgtcagagctttccacctcaagggtgatggtctttccggtgagggtcttgacgaagatctgcatctgtagagtcaacaatcacaagataaatcagaatcaaaatccatcacgtaatttcaagaagcaatttcgtgaaaaaaaatcctaacctaggctggcagcacatcccccgttcgcgagctggcgtaacagcgaagaggcccgggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 91 - DNA, 19084 bp, Artificial Sequence
  pWISE3587 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatttgtaaccaacatcccctgatgataatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggttggtgtgaaacagatgatttgctgctgtaacaaagtaaattatgtctcgacttttaaggcccctttcattttattagattattttattttaattaatgttcttgtcccattttgcaacagatggatgctactacacccaagtattccaaggccaggtatgatgaaattgtgaaggaagtctcttcctacttgaagaaagtaggatacaaccctgacaagattccttttgttcctatctctggttttgagggagacaacatgattgagaggtccacaaaccttgactggtacaagggtccaactctgcttgatgcacttgaccagattagtgagcccaagaggccctctgacaagcccctcaggcttccccttcaggatgtgtacaagattggaggtattggaactgtgccagtgggacgtgttgagaccggtgtcttgaagcctggaatggtggtgacttttgcaccaactggactgacaactgaagtcaagtctgtggagatgcaccatgaatctcttacagaggcacatcctggtgacaatgtgggattcaatgttaagaatgttgctgttaaggatttgaagcgtggttatgttgcctcaaactcaaaggatgaccctgcaaaggaggctgctaacttcacagcccaagtcatcatcatgaaccaccctggtcagattggaaatggctatgcccctgtcctcgactgccacacttctcacattgctgtcaagtttgctgaactcatgaccaagattgacaggcgatccggcaaagagcttgagaaggagcccaagtttttgaagaacggtgatgctggttttgttaagatgattccaaccaaacccatggttgttgaaactttctccgagtatcctccacttggtaggtttgctgttagggacatgcgtcaaactgttgctgtgggagtcatcaagaacgttgagaagaaggatcctaccggagccaaggtcaccaaggctgcccagaagaagaagtcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaatgaatcgtgcgggctggttcatcagggaatgttggctacaatcaatgttggtttcttttctgtactcttgtgtcttcttttctaggtagcttgtttttcggacaaagtttgaagtctccaccatcatctcgcaactgttgttcccagaactgggttcttgatcgacggtggcaaaattgcttttatttatctgtgttttaatgtgttgtgtttgtcggaacccctgattacatttttgttaagcgcagcgagtttcaggactttgctgcgttgtgttgctttggtttattaaatgtcaactttctatttgtagtgttcaatttttggcttggtttgctttttctttataatttgtgttcaaattttggcttggtttgcttttactataatttgtgttcaaattttgggttggattttttaacgatcggctgtttgctcttcttcctctgttttgatgtgttcgtgactatgcaagaatcttcaattttgctaaaataaacttgctttgacaacatagaatcaaatccgagtgctttaatattcggtggtttgtttttatttttggttttatgaaagttaaaattttaaaagtaaatcgataaggtataattgtggtttttatttatcgagaattttttaagtgaatcgatataatttatttcccctaaaataaaataccaaagaatcgaattcgaactttgtctttaataaaactactaatttaatcattatttgttctgtgtaagcatgagaaataaattctacttatcttttagtttaaaaccaaaacaggttaagaataatttttctaaggccgttatcaaggtcaccaaaaatctattcgatctgaccatatattttcgatacttgtacgattcgcagatgttgattggaaattgcaatgaataaattacaaatgccaaatccgattatgcaatgaatgaattacaagtgcatttatccgttttgaatctgttcatgtctaccaatgggagagatttttttcctgcatctgccatacatatgggaagaccgaaaatactttcctaggctggcagcacatcccccgttcgcgagctggcgtaacagcgaagaggcccgggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 92 - DNA, 19084 bp, Artificial Sequence
  pWISE3588 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatttgtaaccaacatcccctgatgataatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggaaagtattttcggtcttcccatatgtatggcagatgcaggaaaaaaatctctcccattggtagacatgaacagattcaaaacggataaatgcacttgtaattcattcattgcataatcggatttggcatttgtaatttattcattgcaatttccaatcaacatctgcgaatcgtacaagtatcgaaaatatatggtcagatcgaatagatttttggtgaccttgataacggccttagaaaaattattcttaacctgttttggttttaaactaaaagataagtagaatttatttctcatgcttacacagaacaaataatgattaaattagtagttttattaaagacaaagttcgaattcgattctttggtattttattttaggggaaataaattatatcgattcacttaaaaaattctcgataaataaaaaccacaattataccttatcgatttacttttaaaattttaactttcataaaaccaaaaataaaaacaaaccaccgaatattaaagcactcggatttgattctatgttgtcaaagcaagtttattttagcaaaattgaagattcttgcatagtcacgaacacatcaaaacagaggaagaagagcaaacagccgatcgttaaaaaatccaacccaaaatttgaacacaaattatagtaaaagcaaaccaagccaaaatttgaacacaaattataaagaaaaagcaaaccaagccaaaaattgaacactacaaatagaaagttgacatttaataaaccaaagcaacacaacgcagcaaagtcctgaaactcgctgcgcttaacaaaaatgtaatcaggggttccgacaaacacaacacattaaaacacagataaataaaagcaattttgccaccgtcgatcaagaacccagttctgggaacaacagttgcgagatgatggtggagacttcaaactttgtccgaaaaacaagctacctagaaaagaagacacaagagtacagaaaagaaaccaacattgattgtagccaacattccctgatgaaccagcccgcacgattcatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgcacgccgtggaaacagaagacatgaccttaagaggacgaagctcagagccaattaacgtcatcccactcttcttcaatccccacgacgacgaaatcggataagctcgtggatgctgctgcgtcttcagagaaaccgataagggagatttgcgttgactggatttcgagagattggagataagagatgggttctgcacaccattgcagattctgctaacttgcgccattggtccagggttagactcaacatcaccggcaagcttcaagaggtcaaaattcagtaattgagttgccacttcatcagcagcatttgacttcttcttctgggcagccttggtgaccttggctccggtaggatccttcttctcaacgttcttgatgactcccacagcaacagtttgacgcatgtccctaacagcaaacctaccaagtggaggatactcggagaaagtttcaacaaccatgggtttggttggaatcatcttaacaaaaccagcatcaccgttcttcaaaaacttgggctccttctcaagctctttgccggatcgcctgtcaatcttggtcatgagttcagcaaacttgacagcaatgtgagaagtgtggcagtcgaggacaggggcatagccatttccaatctgaccagggtggttcatgatgatgacttgggctgtgaagttagcagcctcctttgcagggtcatcctttgagtttgaggcaacataaccacgcttcaaatccttaacagcaacattcttaacattgaatcccacattgtcaccaggatgtgcctctgtaagagattcatggtgcatctccacagacttgacttcagttgtcagtccagttggtgcaaaagtcaccaccattccaggcttcaagacaccggtctcaacacgtcccactggcacagttccaatacctccaatcttgtacacatcctgaaggggaagcctgaggggcttgtcagagggcctcttgggctcactaatctggtcaagtgcatcaagcagagttggacccttgtaccagtcaaggtttgtggacctctcaatcatgttgtctccctcaaaaccagagataggaacaaaaggaatcttgtcagggttgtatcctactttcttcaagtaggaagagacttccttcacaatttcatcatacctggccttggaatacttgggtgtagtagcatccatctgttgcaaaatgggacaagaacattaattaaaataaaataatctaataaaatgaaaggggccttaaaagtcgagacataatttactttgttacagcagcaaatcatctgtttcacaccaacctaggctggcagcacatcccccgttcgcgagctggcgtaacagcgaagaggcccgggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 93 - DNA, 19080 bp, Artificial Sequence
  pWISE3767 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgtgtgatgttcgatgttggatttaatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggttaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattacctaggctggcagcacatcccccgttcgcgagctggcgtaacagcgaagaggcccgggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 94 - DNA, 19080 bp, Artificial Sequence
  pWISE3768 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgtgtgatgttcgatgttggatttaatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggtaatgacatttgtttcatgtataaacctgcgttgttatttgtaaaaatgggattttaacccgatcgcttttgtttttatctgttaaacggatccgattctgattaatttggggtccagtattggagcagaaaaataccactgaatagtgtttttattttttggtatttggtaatcaaatttatattggagcagaaaaatatcactgaataacttgttttttctttttggtattttttggggtccagtatacaaaaacttgcacaaaaattagggattagtatggcattacatcttttaatgattttcaagttattattgattaggaattttttatgtggatctgtgtggggatcatctcaatgtgctttctgtaagacaaggactacctgaagcagaaagattgcataactaaaattgattaggaatttttatgtggacctgtgtggatcatctaaatgtgcattccgcaagccaattaatgttccaactgaagcagattgcttacataatttatatacgataccaaatatgcttcacgagcataatttttaagttgctacctcttggtaaggggcagctaattgaaactagggatcatgatctccgtttgttcaaaaatcctttggtgtgttttcaaaatatcactttagaatctaatccaagagttctccctacctaataaatatctttaacctataataccaaaatctaataattcgtgggatgatcaccatccttcacacaactcatccctgcttttcctccgtgataagcatgaagaataaaaaacccactaatatacgccaattcactggattgagaacaaaattcaaacacaatatgccagcatacagttgataattatatatcagctccacaaattgataacaaacagtagtaacattaatgggacaatagagttcaacacaaaccaaacttattttcaaaggtcattacagacccattacacatcacatttcttcttaaaatgtctgggaaaatccaacatcagacatcacacagacatcagctccagcttatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgcacgccgtggaaacagaagacatgaccttaagaggacgaagctcagagccaattaacgtcatcccactcttcttcaatccccacgacgacgaaatcggataagctcgtggatgctgctgcgtcttcagagaaaccgataagggagatttgcgttgactggatttcgagagattggagataagagatgggttctgcacaccattgcagattctgctaacttgcgccattggtccagggttagactcaacatcaccggcaagcttcaagaggtcaaaattcagtaattgagttgccacttcatcagcagcatttgaaaaccccccacgaagacgcaacaccaagtgcagagttgactccttctggatgttgtagtcagcgagggtccttccatcctctagctgtttgccagcaaaaataagcctctgctggtccggtgggattccttccttgtcctggatcttcgccttcacattgtcaatggtgtcggagctctccacctcgagggtaatagtcttacccgtaagggtcttgacgaagatctgcataccaccacgaagacgcaacaccaagtggagagttgactccttctggatgttgtagtcagcaagggtacgtccgtcctcgagctgcttgccggcgaagatcagcctctgctggtctggggggataccctccttgtcctggatcttagccttgacgttgtcgatggtgtcggagctctcgacttctagggttatagtcttgccggtgagggtcttaacgaagatctgcatgccaccacggagacggaggacgaggtgaagggttgattccttctggatgttgtagtcggcgagggtgcgcccgtcctcaagttgctttccggcgaagatgagacgttgctggtctggggggattccctccttgtcctggatcttggccttgacgttgtcaatggtgtcagagctttcgacctctagggttatggttttgccagtgagagtcttgacgaagatctgcatgccaccacggagacgaaggacaaggtgaagggttgactccttctggatgttgtagtcggcgagggtacggccgtcctcgagctgctttccggcgaagatgagacgttgctgatccgggggaattccttccttgtcctggatcttggccttgacgttgtcgatggtgtcagagctttccacctcaagggtgatggtctttccggtgagggtcttgacgaagatctgcatctgtagagtcaacaatcacaagataaatcagaatcaaaatccatcacgtaatttcaagaagcaatttcgtgaaaaaaaatcctaacctaggctggcagcacatcccccgttcgcgagctggcgtaacagcgaagaggcccgggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 95 - DNA, 18812 bp, Artificial Sequence
  pWISE3788 Full plasmid sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctaaaagattgacacattgcctatactacattctagcgtaggttaaatttatatcagataatgtgggagaaagagatcagttaccattgcatgacaatagctgaccccagatatgagttgttgaaagaagaaacgagcctgtggcatgacaatgggttaatagttacacaggaaatagagagctagcacaagcaaaagtaaacaaattgtataagaacctcatcctcattaaaacgccctgcattgcagattttctcaaatagttctccaccagatgcatattccattacaatgtctagatgagtcggtgttagaataacctgagtcaaatatcaaagaacattttccatgaatatgattattgtacctctgaacataaaaatatataaatacaaatatataccaacctccttaaacctgataatgttaggatgtcttagagacctgtgattaatgatttctcttttaacattttcatcaatctgtgacacacagcaaatgatagggggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttagacgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagatacacctactcatctggccattgttaatttctactaagtgtagatttttttta

SEQ ID NO: 96 - DNA, 19080 bp, Artificial Sequence
  pWISE3771 Full plasmid sequence
aagcttcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgtgtgatgttcgatgttggatttaatttctactaagtgtagattttttttactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctcctaggttaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattacctaggctggcagcacatcccccgttcgcgagctggcgtaacagcgaagaggcccgggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgtccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggctcctccgagacaccaggcacctccgagagcgcgacgcccgagggcggctccggcggctccggcagcccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggtgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttag

SEQ ID NO: 97 - DNA, 526 bp, Agrobacterium tumefaciens
ggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatgggga

SEQ ID NO: 98 - DNA, 1647 bp, Artificial Sequence
  Simian virus 40 (NLS) , Agrobacterium tumefaciens (VirD2), synthetic (Linker and SH3) fusion
atgagcggatcaaaaaaaagaaggatcaagcaagatgcggagtacgtgcgtgctttgtttgatttcaacggcaacgatgaagaagacctgccattcaaaaagggcgacatcctgcgtattcgtgataaaccggaagagcagtggtggaatgcagaggacagcgaaggtaagcgcggtatgatcccggttccgtatgtcgagaagtactccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatag

SEQ ID NO: 99 - protein, 548 aa, Artificial Sequence
  Simian virus 40 (NLS) , Agrobacterium tumefaciens (VirD2), synthetic (Linker), Homo sapiens (SH3) fusion
MSGSKKRRIKQDAEYVRALFDFNGNDEEDLPFKKGDILRIRDKPEEQWWNAEDSEGKRGMIPVPYVEKYSGGSSGGSSGSETPGTSESATPESSGGSSGGSMPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRR

SEQ ID NO: 100 - DNA, 505 bp, Artificial Sequence
  Ost1 HDR template - sense orientation
aaaagattgacacattgcctatactacattctagcgtaggttaaatttatatcagataatgtgggagaaagagatcagttaccattgcatgacaatagctgaccccagatatgagttgttgaaagaagaaacgagcctgtggcatgacaatgggttaatagttacacaggaaatagagagctagcacaagcaaaagtaaacaaattgtataagaacctcatcctcattaaaacgccctgcattgcagattttctcaaatagttctccaccagatgcatattccattacaatgtctagatgagtcggtgttagaataacctgagtcaaatatcaaagaacattttccatgaatatgattattgtacctctgaacataaaaatatataaatacaaatatataccaacctccttaaacctgataatgttaggatgtcttagagacctgtgattaatgatttctcttttaacattttcatcaatctgtgacacacagcaaatgataggg

SEQ ID NO: 101 - DNA, 505 bp, Artificial Sequence
  Ost1 HDR template - antisense orientation
ccctatcatttgctgtgtgtcacagattgatgaaaatgttaaaagagaaatcattaatcacaggtctctaagacatcctaacattatcaggtttaaggaggttggtatatatttgtatttatatatttttatgttcagaggtacaataatcatattcatggaaaatgttctttgatatttgactcaggttattctaacaccgactcatctagacattgtaatggaatatgcatctggtggagaactatttgagaaaatctgcaatgcagggcgttttaatgaggatgaggttcttatacaatttgtttacttttgcttgtgctagctctctatttcctgtgtaactattaacccattgtcatgccacaggctcgtttcttctttcaacaactcatatctggggtcagctattgtcatgcaatggtaactgatctctttctcccacattatctgatataaatttaacctacgctagaatgtagtataggcaatgtgtcaatctttt

SEQ ID NO: 102 - DNA, 3149 bp, Artificial Sequence
  EF1alpha HDR template with aadA insertion
ttggtgtgaaacagatgatttgctgctgtaacaaagtaaattatgtctcgacttttaaggcccctttcattttattagattattttattttaattaatgttcttgtcccattttgcaacagatggatgctactacacccaagtattccaaggccaggtatgatgaaattgtgaaggaagtctcttcctacttgaagaaagtaggatacaaccctgacaagattccttttgttcctatctctggttttgagggagacaacatgattgagaggtccacaaaccttgactggtacaagggtccaactctgcttgatgcacttgaccagattagtgagcccaagaggccctctgacaagcccctcaggcttccccttcaggatgtgtacaagattggaggtattggaactgtgccagtgggacgtgttgagaccggtgtcttgaagcctggaatggtggtgacttttgcaccaactggactgacaactgaagtcaagtctgtggagatgcaccatgaatctcttacagaggcacatcctggtgacaatgtgggattcaatgttaagaatgttgctgttaaggatttgaagcgtggttatgttgcctcaaactcaaaggatgaccctgcaaaggaggctgctaacttcacagcccaagtcatcatcatgaaccaccctggtcagattggaaatggctatgcccctgtcctcgactgccacacttctcacattgctgtcaagtttgctgaactcatgaccaagattgacaggcgatccggcaaagagcttgagaaggagcccaagtttttgaagaacggtgatgctggttttgttaagatgattccaaccaaacccatggttgttgaaactttctccgagtatcctccacttggtaggtttgctgttagggacatgcgtcaaactgttgctgtgggagtcatcaagaacgttgagaagaaggatcctaccggagccaaggtcaccaaggctgcccagaagaagaagtcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaatgaatcgtgcgggctggttcatcagggaatgttggctacaatcaatgttggtttcttttctgtactcttgtgtcttcttttctaggtagcttgtttttcggacaaagtttgaagtctccaccatcatctcgcaactgttgttcccagaactgggttcttgatcgacggtggcaaaattgcttttatttatctgtgttttaatgtgttgtgtttgtcggaacccctgattacatttttgttaagcgcagcgagtttcaggactttgctgcgttgtgttgctttggtttattaaatgtcaactttctatttgtagtgttcaatttttggcttggtttgctttttctttataatttgtgttcaaattttggcttggtttgcttttactataatttgtgttcaaattttgggttggattttttaacgatcggctgtttgctcttcttcctctgttttgatgtgttcgtgactatgcaagaatcttcaattttgctaaaataaacttgctttgacaacatagaatcaaatccgagtgctttaatattcggtggtttgtttttatttttggttttatgaaagttaaaattttaaaagtaaatcgataaggtataattgtggtttttatttatcgagaattttttaagtgaatcgatataatttatttcccctaaaataaaataccaaagaatcgaattcgaactttgtctttaataaaactactaatttaatcattatttgttctgtgtaagcatgagaaataaattctacttatcttttagtttaaaaccaaaacaggttaagaataatttttctaaggccgttatcaaggtcaccaaaaatctattcgatctgaccatatattttcgatacttgtacgattcgcagatgttgattggaaattgcaatgaataaattacaaatgccaaatccgattatgcaatgaatgaattacaagtgcatttatccgttttgaatctgttcatgtctaccaatgggagagatttttttcctgcatctgccatacatatgggaagaccgaaaatacttt

SEQ ID NO: 103 - DNA, 3149 bp, Artificial Sequence
  EF1alpha HDR template with aadA insertion
aaagtattttcggtcttcccatatgtatggcagatgcaggaaaaaaatctctcccattggtagacatgaacagattcaaaacggataaatgcacttgtaattcattcattgcataatcggatttggcatttgtaatttattcattgcaatttccaatcaacatctgcgaatcgtacaagtatcgaaaatatatggtcagatcgaatagatttttggtgaccttgataacggccttagaaaaattattcttaacctgttttggttttaaactaaaagataagtagaatttatttctcatgcttacacagaacaaataatgattaaattagtagttttattaaagacaaagttcgaattcgattctttggtattttattttaggggaaataaattatatcgattcacttaaaaaattctcgataaataaaaaccacaattataccttatcgatttacttttaaaattttaactttcataaaaccaaaaataaaaacaaaccaccgaatattaaagcactcggatttgattctatgttgtcaaagcaagtttattttagcaaaattgaagattcttgcatagtcacgaacacatcaaaacagaggaagaagagcaaacagccgatcgttaaaaaatccaacccaaaatttgaacacaaattatagtaaaagcaaaccaagccaaaatttgaacacaaattataaagaaaaagcaaaccaagccaaaaattgaacactacaaatagaaagttgacatttaataaaccaaagcaacacaacgcagcaaagtcctgaaactcgctgcgcttaacaaaaatgtaatcaggggttccgacaaacacaacacattaaaacacagataaataaaagcaattttgccaccgtcgatcaagaacccagttctgggaacaacagttgcgagatgatggtggagacttcaaactttgtccgaaaaacaagctacctagaaaagaagacacaagagtacagaaaagaaaccaacattgattgtagccaacattccctgatgaaccagcccgcacgattcatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgcacgccgtggaaacagaagacatgaccttaagaggacgaagctcagagccaattaacgtcatcccactcttcttcaatccccacgacgacgaaatcggataagctcgtggatgctgctgcgtcttcagagaaaccgataagggagatttgcgttgactggatttcgagagattggagataagagatgggttctgcacaccattgcagattctgctaacttgcgccattggtccagggttagactcaacatcaccggcaagcttcaagaggtcaaaattcagtaattgagttgccacttcatcagcagcatttgacttcttcttctgggcagccttggtgaccttggctccggtaggatccttcttctcaacgttcttgatgactcccacagcaacagtttgacgcatgtccctaacagcaaacctaccaagtggaggatactcggagaaagtttcaacaaccatgggtttggttggaatcatcttaacaaaaccagcatcaccgttcttcaaaaacttgggctccttctcaagctctttgccggatcgcctgtcaatcttggtcatgagttcagcaaacttgacagcaatgtgagaagtgtggcagtcgaggacaggggcatagccatttccaatctgaccagggtggttcatgatgatgacttgggctgtgaagttagcagcctcctttgcagggtcatcctttgagtttgaggcaacataaccacgcttcaaatccttaacagcaacattcttaacattgaatcccacattgtcaccaggatgtgcctctgtaagagattcatggtgcatctccacagacttgacttcagttgtcagtccagttggtgcaaaagtcaccaccattccaggcttcaagacaccggtctcaacacgtcccactggcacagttccaatacctccaatcttgtacacatcctgaaggggaagcctgaggggcttgtcagagggcctcttgggctcactaatctggtcaagtgcatcaagcagagttggacccttgtaccagtcaaggtttgtggacctctcaatcatgttgtctccctcaaaaccagagataggaacaaaaggaatcttgtcagggttgtatcctactttcttcaagtaggaagagacttccttcacaatttcatcatacctggccttggaatacttgggtgtagtagcatccatctgttgcaaaatgggacaagaacattaattaaaataaaataatctaataaaatgaaaggggccttaaaagtcgagacataatttactttgttacagcagcaaatcatctgtttcacaccaa

SEQ ID NO: 104 - DNA, 3145 bp, Artificial Sequence
  Polyubiquitin HDR template with aadA insertion
ttaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcatta

SEQ ID NO: 105 - DNA, 3145 bp, Artificial Sequence
  Polyubiquitin HDR template with aadA insertion
taatgacatttgtttcatgtataaacctgcgttgttatttgtaaaaatgggattttaacccgatcgcttttgtttttatctgttaaacggatccgattctgattaatttggggtccagtattggagcagaaaaataccactgaatagtgtttttattttttggtatttggtaatcaaatttatattggagcagaaaaatatcactgaataacttgttttttctttttggtattttttggggtccagtatacaaaaacttgcacaaaaattagggattagtatggcattacatcttttaatgattttcaagttattattgattaggaattttttatgtggatctgtgtggggatcatctcaatgtgctttctgtaagacaaggactacctgaagcagaaagattgcataactaaaattgattaggaatttttatgtggacctgtgtggatcatctaaatgtgcattccgcaagccaattaatgttccaactgaagcagattgcttacataatttatatacgataccaaatatgcttcacgagcataatttttaagttgctacctcttggtaaggggcagctaattgaaactagggatcatgatctccgtttgttcaaaaatcctttggtgtgttttcaaaatatcactttagaatctaatccaagagttctccctacctaataaatatctttaacctataataccaaaatctaataattcgtgggatgatcaccatccttcacacaactcatccctgcttttcctccgtgataagcatgaagaataaaaaacccactaatatacgccaattcactggattgagaacaaaattcaaacacaatatgccagcatacagttgataattatatatcagctccacaaattgataacaaacagtagtaacattaatgggacaatagagttcaacacaaaccaaacttattttcaaaggtcattacagacccattacacatcacatttcttcttaaaatgtctgggaaaatccaacatcagacatcacacagacatcagctccagcttatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgcacgccgtggaaacagaagacatgaccttaagaggacgaagctcagagccaattaacgtcatcccactcttcttcaatccccacgacgacgaaatcggataagctcgtggatgctgctgcgtcttcagagaaaccgataagggagatttgcgttgactggatttcgagagattggagataagagatgggttctgcacaccattgcagattctgctaacttgcgccattggtccagggttagactcaacatcaccggcaagcttcaagaggtcaaaattcagtaattgagttgccacttcatcagcagcatttgaaaaccccccacgaagacgcaacaccaagtgcagagttgactccttctggatgttgtagtcagcgagggtccttccatcctctagctgtttgccagcaaaaataagcctctgctggtccggtgggattccttccttgtcctggatcttcgccttcacattgtcaatggtgtcggagctctccacctcgagggtaatagtcttacccgtaagggtcttgacgaagatctgcataccaccacgaagacgcaacaccaagtggagagttgactccttctggatgttgtagtcagcaagggtacgtccgtcctcgagctgcttgccggcgaagatcagcctctgctggtctggggggataccctccttgtcctggatcttagccttgacgttgtcgatggtgtcggagctctcgacttctagggttatagtcttgccggtgagggtcttaacgaagatctgcatgccaccacggagacggaggacgaggtgaagggttgattccttctggatgttgtagtcggcgagggtgcgcccgtcctcaagttgctttccggcgaagatgagacgttgctggtctggggggattccctccttgtcctggatcttggccttgacgttgtcaatggtgtcagagctttcgacctctagggttatggttttgccagtgagagtcttgacgaagatctgcatgccaccacggagacgaaggacaaggtgaagggttgactccttctggatgttgtagtcggcgagggtacggccgtcctcgagctgctttccggcgaagatgagacgttgctgatccgggggaattccttccttgtcctggatcttggccttgacgttgtcgatggtgtcagagctttccacctcaagggtgatggtctttccggtgagggtcttgacgaagatctgcatctgtagagtcaacaatcacaagataaatcagaatcaaaatccatcacgtaatttcaagaagcaatttcgtgaaaaaaaatcctaa

SEQ ID NO: 106 - DNA, 3149 bp, Artificial Sequence; identical to SEQ ID NO: 102
  EF1alpha HDR template with aadA insertion

SEQ ID NO: 107 - DNA, 3149 bp, Artificial Sequence; identical to SEQ ID NO: 103
  EF1alpha HDR template with aadA insertion

SEQ ID NO: 108 - DNA, 3145 bp, Artificial Sequence; identical to SEQ ID NO: 104
  Polyubiquitin HDR template with aadA insertion

SEQ ID NO: 109 - DNA, 3145 bp, Artificial Sequence; identical to SEQ ID NO: 105
  Polyubiquitin HDR template with aadA insertion

SEQ ID NO: 110 - DNA, 505 bp, Artificial Sequence; identical to SEQ ID NO: 100
  Ost1 HDR template - antisense orientation

SEQ ID NO: 111 - DNA, 3145 bp, Artificial Sequence; identical to SEQ ID NO: 104
  Polyubiquitin HDR template with aadA insertion

SEQ ID NO: 112 - DNA, 5382 bp, Artificial Sequence
  Polyubiquitin Locus with aadA insertion
tttcatcgattataaattttcataatcagaagattcagcttttattaatgcaagaacgtccttaattgatgattttataaccgtaaattaggtctaattagagtttttttcataaagattttcagatccgtttacaacaagccttaattgttgattctgtagtcgtagattaaggtttttttcatgaactacttcagatccgttaaacaacagccttatttgttgatacttcagtcgtttttcaagaaattgttcagatccgttgataaaagccttattcgttgattctgtatggtatttcaagagatattgctcaggtcctttagcaactaccttatttgttgattctgtggccatagattaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaattttgtaattatatggattaataaaaggttcctcccagagttaaattgttgtgttggcgtgcgtgtagagcttctcttccaacaagagacaagcttgagatcgtggagtaacctgtcccttaacgtgctctttgttctctttgtgcgagggtggcattgaaaatacatttcacgtgcttacagtttgcccgaggatcatggaatgctggcagaagttggggttgagcagcagaagttgatagaattcttcttcaaactcatgctttctattgaatcttatcaacaatgtagagtagctataactctctggagagtgcttggagatgtcactatgatgctgtttgaggagggactatcacggattccgccatcgtgatcagcagagatgacatgttttatcaagattgggttcgtgcacaactagcaaataaatttagacaggttgcagaattgatggagatgaatgattcttggagtccaccggccattggaaggttaaaatgtaacgttgatgcatctctcaatcatattcaaaactgcacagtttttggtttatgcattcgggcatcttattgttgccagaattgatgttgtgaaaccatgcatgcctgttatggagggagaggcgttagggttgctgttggcgattcagttttttctatatgcgggaatgcaaaatgtggactttgaaacagattgtaaagggtgtgttgatagaaaaataaaataaaatacccacccttgatattagcagaggaaatattttctgtaaatgtaaaattttgttacaacccgctcttttattttcttttatagagcaattctctacacttgtctaagaatctataatacttacattactaatcttactaacacaagcttcttgtaggtatgtctggatggagaattttagaagaaaagtgatttttttttaattttttaattaaaggagttgtacaatgttgtgagaaaaaaactaggaaatattaaatgatttcatcataaaacatcgttttactattttttttattttggtaaattgctccaataaataaatcttatgtaaaccactttttagtatatattaaaaaaatattatttatgagtgctacattctctaagaggaagatggtctattattacttgggagcccatttcttcagcatacgatgcacaaataagccgctagtgctaattcaattttggggttatctaactatccttccggcgaaacttgatgcaggaaaacgtttgtttaatacttgacatgaattcaacgaacaacctctttgaggggacaatcagaagcacaaaccaagcaccgaatcatccaagtttgctatcttacgcaaggcattaggtataaacctagtttgaataaatttttcaagtactcgtaggaaataaatacaggtaaaataaatcaaacatctataagatcaatccaacttatagacactttagtttttctagaagttagacgaaaaaacttgtaaaaaagacaaaatgctgcacaagttaattttaatttatgaccaaagttttattcattttatcaaccttattttcttcttccataaatatttgttgaaaagcttattcaaattggaccatagagcatgttggaatgagaattttagcacgttactcaatccaacagcatcataacaacttaatggaaccggaattttcacgccatggcatatg

SEQ ID NO: 113 - DNA, 40 bp, Artificial Sequence
  Polyubiquitin left flank primer
ggtatttcaagagatattgctcaggtcctttagcaactac

SEQ ID NO: 114 - DNA, 27 bp, Artificial Sequence
  aadA specific primer for left flank PCR
gggttctgcacaccattgcagattctg

SEQ ID NO: 115 - DNA, 18505 bp, Artificial Sequence
  pWISE3091 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 116 - DNA, 18472 bp, Artificial Sequence
  pWISE3095 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgtccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggctcctccgagacaccaggcacctccgagagcgcgacgcccgagggcggctccggcggctccggcagcgcagagtatgttcgtgccctttttgattttaacggcaatgatgaagaggatttgcccttcaagaaaggtgacatcctccgaataagggacaaaccagaagaacaatggtggaatgctgaagattctgaagggaagagaggaatgattcctgtcccttatgtggagaagtactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 117 - DNA, 19066 bp, Artificial Sequence
  pWISE3097 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgtccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggctcctccgagacaccaggcacctccgagagcgcgacgcccgagggcggctccggcggctccggcagcggtccagacatcgttatgactcaatccccctcaagcctttcagcctccgtgggcgacagagttaccattacctgccgctcaagcactggagcagtgaccacttctaactacgctagctgggtgcaggagaagccaggaaagctgttcaaggggctgattggaggcacaaacaatagagcccctggcgtgccatccaggttttctggaagcctgattggcgataaggcaacactgaccatctctagcctgcagcccgaggacttcgctacctacttttgcgccctgtggtatagcaatcactgggtgttcggtcaggggactaaggtggaactgaagagaggtgggggaggctccggtgggggaggctcaggtgggggaggctcctcaggtgggggatctgaggtgaagctgctggaaagcggcggtgggctggtgcagcccggaggctccctgaagctgtcatgtgccgtgtctggattttcactgaccgattacggcgtgaactgggtgagacaggcccctggaaggggactggagtggattggagtgatttggggagatgggatcacagactacaattccgcactgaaggatagattcattatctcaaaggacaacggaaagaacaccgtgtatctgcagatgtctaaggtgaggagcgatgacactgccctgtactattgcgtgacagggctgtttgactattgggggcaaggcactctggttaccgtgagcagctatccatacgatgttcccgactacgcttgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 118 - DNA, 16312 bp, Artificial Sequence
  pWISE768 Full Plasmid Sequence
cccataatagctgtttgccaatcgttcttcttggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtggtaccaaaaaatggcgggatctaagaagagaagaattaaacaagattccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggcccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggatctaagaagagaagaattaaacaagattgacttaattaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctcgggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcgctctcttaaggtagcaaggatccctgaaagcgacgttggatgttaacatctacaaattgccttttcttatcgaccatgtacgtaagcgcttacgtttttggtggacccttgaggaaactggtagctgttgtgggcctgtggtctcaagatggatcattaatttccaccttcacctacgatggggggcatcgcaccggtgagtaatattgtacggctaagagcgaatttggcctgtagacctcaattgcgagctttctaatttcaaactattcgggcctaacttttggtgtgatgatgctgactggcaggatatataccgttgtaatttgagctcgtgtgaataagtcgctgtgtatgtttgtttgattgtttctgttggagtgcagcccatttcaccggacaagtcggctagattgatttagccctgatgaactgccgaggggaagccatcttgagcgcggaatgggaatggatttcgttgtacaacgagacgacagaacacccacgggaccgagcttcgaagctttaacgcttgagttaagccgcgccgcgaagcggcgtcggcttgaacgaattgttagacatcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatggctttgtttctccttcaatcattgactattgtcacgttattctgaatcgacgagaactcacatcaatctcaacaagcatctctgctcgcgaaattggtgttgtctcattaaaacgtgaccgtcaaagtctattcactaggacccaaatctctccaggtcccgcaagctagcttcgccgcccacgtttctctttcttctcatattcaattgtcaaaaaacagacctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactttttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacaggctctccttcacgatcaacgatcggcatggggccttcgtgcttgttgagtaatgttatcgctcccatcagagcacgcttggtactccgggaatcggatggtctgtcgatcatccaaaaaacgctcatgttttcaacctattaggtctgtggtcagctgaccacagaccatcctgctccatactcgctaattctagccaaaccgcaacgtcccctgcccgctagccttcaagagcgccattatcatcgggccaagtgaaaacttcccgagctcgctccgccgtgtcagatctcggagatagcccccgggcgaattgatgaagttcgctcgctccaaaatgcacgccatcgctgctgccgcattctccggtcccattgcctcacacgcgtcttggtaagccgacgggctgacccccagcatagaccgaaccaccaccgcagccgacatgaggtcacgccagctagcaaccgcaccgctcggcccataattgccaatggtcgggcatgctttcaggatcatcccgagggggaacgcttttatcggctcgctccttgcccggtctatttcactcggcttagcgccctgctccttttcagagcgaggttcaagttcattaacggattcgggttttgaattctgtatgtgctgctcgctctgggcagcattggtgctattattttctgaattgtctctaatttccaaccggttgattatctcttcctggagcatccacatctcttcgagaattgactctacatcagcaagcgtcggggcgcgtggaattctacccacaagttccacatagacttcctcgacagcttgccagtcgccctccgctccctcttccatagctgccgtaattagcttccgaacgtcccgtcggcaaatcgtcagactttctttggccatcctgaatgctgctcgatcggccatcacctgctgtgccatcatcgctagctcttcggaccgcgcgagaagcggagacaaatcgaagccaaacgcgcgctcgatctgaccagcgccatccttacgagcgtaacgctttccgttggcgctatccttccggacgatcaagcctgactccacgagcatggcgatgtgcctacgcaaagtcgcgccagccatcccatgcgcccgaagggcaagctgagcattcgacgggaagacgatcagctgtgcctcctgacgcaactccgtttccgggtgaaagctcaatagcgcatcaaggacggcaagactgttggactggattccaagtagttccatggccgcggacgcgtctctaaagaccttccacttgtccgctgtcttgccttgtttgatatcggccagcgccgtctggcgccgcacaagcgcaagcgtcattggccgccgcccgaatggcgtcgttacacttcctgtctgcatcatctttcacctttcagcaggcaaaggaaatcagctcaccaaaacggcgctaaaaactcttgacgaggattcgaggaaatgcgattctgttcgcgctagagagacagaagggcttccgcgacggcgacgttgagggggctcttttcttttgcggtttactctccccgtttccgttggttctcagcgtggtacgcttgatacagcgctggcacatgatcgagcacgaaggtcgcaaaatcgggcgtcgccttcctgtcaatcgtgatttccagtttggccttgctctgcgtcacctgtgcaattctggtgccgtctggggtggccatgacctcgggaagtccacgcgcaacccgactgggcttcagactagcgatcaccgccttgaatcgttctgccgatggcagcgcttgaacttcctccgacatagcatatttagccacgtcggccggtgaagaaactttctcaatcagctcggcaagttgttgccaactcggccgtccaacaccaggagcggcaccaatagcatcggtcagttcagaggggagggcgtcgacgagcagaagcatcttggacaaattgctcttgtcgatcgacatcgcggcgatgacaatctctcgagaaaactgcctgttcaggcgatgtgcgaagcgcgccttttcgatgaaggtaagatcttcgcgctcattgttttcctgaccctgtgctacgaccacttgctcgtccgtcagttcgcgaacgaccgctctgaccggaagtccgagttctgaaacggcgcgtagccggcggtggccgaaggcaacctgatatcggcccggctggctcggatgcggtcgcacaaggattgggacttgctgtccttgttcccggatcgaagtaaggagcccgtcaatgtcccctcgcatacgatcctgcacgaaagacggttctattgacgaggcatccaactctatcactgcctgaccttcagcgagacgccgctcgatctcttcggcacggctaagacgatcgttttgctctcgcagtgcgttaccaatgttcgctgtgagcttcgttgccggatcgcgctccttccttgttacgccgaggagcggcatggagcggttctttgccgtcctattgtcggcgggcgacgtctcaggggcgtcagttgagacgccaaggatgtgcttccggctcatgtgggcctaccccatgcttttttgatcagtgtttcgatctcgtcgttgacggcgttcatcgcctccaaggctcgatcataggtcgagcgcgtgaacaggccacgctccacttcgaatagagtctggtttgtcaggccagcgtccgaaaccgcggtggttttaagcatcggaaaattgaggacattttcgccaaaaatcgaccgcagataacctaccatttggttctgtggtccgtcgctcggttcgaaacgggttatcagatagcgcatccaattaaacttgaacttggcgccagcattctcgatttcacgcaaaaggttcgatgtcattgccagaaactggttcatcgacatcacatccagcatctgcggatggaccgtgacaagaatggacgtcgccgcagtcaatgcggatagcgtgagatacccaagctggggagggcagtcgatgaccacgacgtcatagttatccgcgatatcttcaattacttggctgatgcgaccataaaagagcgtgtcgccctctttgcggttcatcagcgcgcgtggcgtatcgtgttcaaactccatcagctcaaggttaccaggaatcaggtggaggtcgggaatgtaagtccctcggacgactcgttcgattgccacctgctcatcatcataccttatagcgccgtagagcgtttcgttcgggccaacgtccgtctccggttggctcccaaagagtgcagaaaggctcgcttgaggatcgagatcaatggccaagactcgatatccgcgcatagcgaggtactgcgccagatgcgcggcggtggtggtcttacccgacccacctttgaaattcatcacagagataacctgaagctgctcgccgcctcgacgatgtggcaggtagcgccggttcccgcggccgacctgatccatatacttccgaatcacatggatatcttcaattgagaacattcgcctgccacccgggctcatgctaacattcaactctggcatctcagacgcggtctgccgtaaatatgactcgccaacgccgagcagcttggacgcctccgatggcccgaatgttcgaatgcccttctcggaatgcggcgggaaaaccttaagatgatgtgcttgaagttggctcgagagggcatcggcatgacgctccatcaaggccgtcaaccctacaactacaggcgctgcttttaggacagacttcgccatctcaaacccattccttgccagtggcgatatttttcgcgaaactggaaaagttccgccgctggcaattagcgccgattctgctgtttgggcaagagcttttaggttaacagaaggttaacgccctcaggtcgaaaaactccacccaactgttatttgtatttatttccaatgccttagagagattgccatttgaatatgttcatgtattgttttagtgataatcctacaatcgtaacccaaaaagaggtcgccctctgcgcgccgtcgtccaatataggcgaagtcacccttgcgactcaggcggattctaccttgtacacgtgtcgagtggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccctaggcgtacgataacttcgtataatgtatgctatacgaagttatcactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatccaacgttataacttcgtataatgtatgctatacgaagttattaactataacggtcctaaggtagcgacttaggctgagcccgggcaggcctacccataata

SEQ ID NO: 119 - DNA, 6973 bp, Artificial Sequence
  pWISE3030 Full Plasmid Sequence
tcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtc

SEQ ID NO: 120 - DNA, 7378 bp, Artificial Sequence
  pWISE3115 Full Plasmid Sequence
gcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggatcaaaaaaaagaaggatcaagcaagatgcggagtacgtgcgtgctttgtttgatttcaacggcaacgatgaagaagacctgccattcaaaaagggcgacatcctgcgtattcgtgataaaccggaagagcagtggtggaatgcagaggacagcgaaggtaagcgcggtatgatcccggttccgtatgtcgagaagtactccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgc

SEQ ID NO: 121 - DNA, 7234 bp, Artificial Sequence
  pWISE3122 Full Plasmid Sequence
accggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtgggggctcctcgggtggcagcatgagcggatcaaaaaaaagaaggatcaagcaagatgcggagtacgtgcgtgctttgtttgatttcaacggcaacgatgaagaagacctgccattcaaaaagggcgacatcctgcgtattcgtgataaaccggaagagcagtggtggaatgcagaggacagcgaaggtaagcgcggtatgatcccggttccgtatgtcgagaagtactccggtagtggggggtcctctggtggaagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgccc

SEQ ID NO: 122 - DNA, 7309 bp, Artificial Sequence
  pWISE3109 Full Plasmid Sequence
cgcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgagcggatcaaaaaaaagaaggatcaagcaagatccgccgccagcgctgccgcccaagcgccgtcgctccggcggtagcagcggtggttccccgccgccggctctgccgccgaagcgccgtagaagcggcggttcaagcggtggctctccgccaccggcactgcctccgaaacgtcgtcgttctggcggtagcagcggtggctcgccgccgccggcgttgccgccgaaacgccgtcgttccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccg

SEQ ID NO: 123 - DNA, 8158 bp, Artificial Sequence
  pWISE3103 Full Plasmid Sequence
ccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgagcggatcaaagaaaagaaggatcaagcaagatgaggaattgctgagtaaaaactaccatcttgagaacgaagttgcccgtctgaagaagggtagcggttcgggcggtagcggttccggaggtagcggcagcggctcgggtggtagcggttcaggtggctcaggcagtggtgaagaattgctgagcaaaaattatcacctggagaatgaagttgcgcgtctgaagaaaggcagcggctccggtggttctggctcgggcggttcaggtagtggttccggtggctccggcagcggtggttctggctccggtgaagagttgttgtccaagaattatcatctggaaaacgaagtggcaagactcaagaagggttcgggttcgggcggcagcggaagtggtggtagcggaagcggcagcggcggctccggctccggtggctccggcagcggtgaggagctgctgagcaagaactaccacttggagaacgaagtggcacgcctgaagaaaggtagcggtagcggcggttctgggagcggtggctccggaagcggcagcggcggttcgggttctggtggcagcggtagcggcgaagagctgcttagcaaaaattatcaccttgagaacgaggtcgctcgcctgaaaaaaggttccggcagcggcggtagcggtagcggtggcagcggtagcggcagcggtggctcggggtccggtggtagcggctccggtgaagaattgttgtccaaaaactaccacctggagaatgaagtggcgcgtctgaaaaagggtagcggcagcggtggtagcggctctggaggtagcggctccggtagtggcggtagcgggtctggcggctctggttcaggcgaagaactgctcagcaagaattaccatttggagaacgaggttgcgcgcctgaaaaagggctctggtagcggcggttctggctctggtggcagcgggagcggctccggtggcagcggctctggaggttccggttcgggtgaggagctgctgagcaagaactaccacctggaaaacgaggtggcgcgtctgaaaaaaggcagcaagaaacgtcgtatcaaacaggactccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgccca

SEQ ID NO: 124 - DNA, 12647 bp, Artificial Sequence
  pWISE711 Full Plasmid Sequence
agcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatccactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccttagctagttaga

SEQ ID NO: 125 - DNA, 10918 bp, Artificial Sequence
  pWISE3111 Full Plasmid Sequence
gcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgc

SEQ ID NO: 126 - DNA, 10774 bp, pWISE3118 Full Plasmid Sequence
cggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtgggggctcctcgggtggcagcatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtagtggggggtcctctggtggaagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccac

SEQ ID NO: 127 - DNA, 12424 bp, Artificial Sequence
  pWISE2737 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 128 - DNA, 7198 bp, Artificial Sequence
  pWISE3106 Full Plasmid Sequence
cgcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgagcaattcaacaattaaaatcgcaacaaggaagtacctgggtaaacagaatgtttatgacatcggcgtggagcgtgatcacaatttcgctttgaagaacggttttattgcgagcaactgcttcaactccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccg

SEQ ID NO: 129 - DNA, 8260 bp, Artificial Sequence
  pWISE3110 Full Plasmid Sequence
aaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggatcaaagaaaagaaggatcaagcaagatgaggaattgctgagtaaaaactaccatcttgagaacgaagttgcccgtctgaagaagggtagcggttcgggcggtagcggttccggaggtagcggcagcggctcgggtggtagcggttcaggtggctcaggcagtggtgaagaattgctgagcaaaaattatcacctggagaatgaagttgcgcgtctgaagaaaggcagcggctccggtggttctggctcgggcggttcaggtagtggttccggtggctccggcagcggtggttctggctccggtgaagagttgttgtccaagaattatcatctggaaaacgaagtggcaagactcaagaagggttcgggttcgggcggcagcggaagtggtggtagcggaagcggcagcggcggctccggctccggtggctccggcagcggtgaggagctgctgagcaagaactaccacttggagaacgaagtggcacgcctgaagaaaggtagcggtagcggcggttctgggagcggtggctccggaagcggcagcggcggttcgggttctggtggcagcggtagcggcgaagagctgcttagcaaaaattatcaccttgagaacgaggtcgctcgcctgaaaaaaggttccggcagcggcggtagcggtagcggtggcagcggtagcggcagcggtggctcggggtccggtggtagcggctccggtgaagaattgttgtccaaaaactaccacctggagaatgaagtggcgcgtctgaaaaagggtagcggcagcggtggtagcggctctggaggtagcggctccggtagtggcggtagcgggtctggcggctctggttcaggcgaagaactgctcagcaagaattaccatttggagaacgaggttgcgcgcctgaaaaagggctctggtagcggcggttctggctctggtggcagcgggagcggctccggtggcagcggctctggaggttccggttcgggtgaggagctgctgagcaagaactaccacctggaaaacgaggtggcgcgtctgaaaaaaggcagcaagaaacgtcgtatcaaacaggactccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccgg

SEQ ID NO: 130 - DNA, 7519 bp, Artificial Sequence
  pWISE3113 Full Plasmid Sequence
cgcgcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggatcaaagaaaagaaggatcaagcaagatggctcttgtctgagctatgaaaccgaaatcctcactgtagagtatggtttgctgccgatcggcaagatcgtggagaaacgtattgagtgcaccgtctactccgtggacaacaacggtaatatttacacccagccggttgctcagtggcacgaccgcggtgaacaagaggttttcgagtactgcttggaagatggtagcctgattcgcgcgaccaaagatcataagtttatgacggtggacggccaaatgctgccgattgatgaaatcttcgaacgtgaactggatctgatgcgtgttgacaacctgccaaattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccc

SEQ ID NO: 131 - DNA, 18607 bp, Artificial Sequence
  pWISE3094 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgtccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggctcctccgagacaccaggcacctccgagagcgcgacgcccgagggcggctccggcggctccggcagctgtttgagttatgaaactgagatcctcaccgttgaatatggtctgttacccattggaaaaattgttgagaagaggattgaatgcacggtctactctgtagacaacaatggaaacatatacactcagcctgtggctcagtggcatgatagaggggagcaagaagtttttgagtattgtcttgaagatggctcactaatccgtgcaacaaaagatcacaagttcatgacagttgatggtcaaatgcttcctattgatgaaatatttgaaagagagcttgatttgatgagggtggacaatttgccaaattgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 132 - DNA, 18505 bp, Artificial Sequence
  pWISE3096 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgtccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggctcctccgagacaccaggcacctccgagagcgcgacgcccgagggcggctccggcggctccggcagcccgccgcctgccctccctccaaagaggcgaagaagtggtggatcttccggggggtccccccctcctgctttacctccaaaaagacgtcgttctggtggttcaagtggaggttctccacctcctgcacttcctcccaagagaagaaggagcggcggcagctcaggaggatcaccaccaccagctttgccacccaaaaggcgccggtgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 133 - DNA, 19066 bp, Artificial Sequence
  pWISE3092 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgggtccagacatcgttatgactcaatccccctcaagcctttcagcctccgtgggcgacagagttaccattacctgccgctcaagcactggagcagtgaccacttctaactacgctagctgggtgcaggagaagccaggaaagctgttcaaggggctgattggaggcacaaacaatagagcccctggcgtgccatccaggttttctggaagcctgattggcgataaggcaacactgaccatctctagcctgcagcccgaggacttcgctacctacttttgcgccctgtggtatagcaatcactgggtgttcggtcaggggactaaggtggaactgaagagaggtgggggaggctccggtgggggaggctcaggtgggggaggctcctcaggtgggggatctgaggtgaagctgctggaaagcggcggtgggctggtgcagcccggaggctccctgaagctgtcatgtgccgtgtctggattttcactgaccgattacggcgtgaactgggtgagacaggcccctggaaggggactggagtggattggagtgatttggggagatgggatcacagactacaattccgcactgaaggatagattcattatctcaaaggacaacggaaagaacaccgtgtatctgcagatgtctaaggtgaggagcgatgacactgccctgtactattgcgtgacagggctgtttgactattgggggcaaggcactctggttaccgtgagcagctatccatacgatgttcccgactacgctggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 134 - DNA, 18424 bp, Artificial Sequence
  pWISE3089 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgaactctactatcaaaattgcaacaaggaaataccttgggaagcaaaatgtttatgatattggtgtggaaagagaccataattttgctttgaagaatggatttatagcctcaaattgtttcaacggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 135 - DNA, 18232 bp, Artificial Sequence
  pWISE3088 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccattgggatcctgcagggagccactgaaattctgtaagaactacattcgccgtgagtttgacataatcacaacgagccactgaaattttgtaaaaactacacttaagagcttcaacaaaatcagtgtcacggtaatttttgtcaaaattcactaattcaaaagctaatgccaaaaattggcaatgactcaactcaagaatctcatcttccacagggtaagctgttaccataaggtgagaacataatagaatttgataattgaaattttgcattgcaaggcattattaccaagagaagtctatgccaaagccacaacactaaacagatgtattaagcccaaagggagacacaaagaagctacaaacaagtacttattgcttttacatcatcacgataagctttggttcagtactaacatcagcaattaaaaggccacacaataagagatgttctcatggtcataattgtaattacagagctcaataatgaaagtatgaaatcatgacagagagccctttcagtgcttcacggaggtctgcgcgtactccagccactccttgttggaaatggcaattttcaccttgtcgagcttctcatcctccgcctttttgaactgcccgatggcccagagcactttcctggcgatattataggccccgttcgcatcggcgttcttcgggaggatcgcattctcttgcgcctcatagttgcgggagtcgtaaaagatcccgtcggagttcttcaccgggctgatgaggaagtcgacgtcggtgcgccctgtgatgctattcctcatttggagcatcagggacatgagggccatgaagctggagtaaaacgctttgtcggactgctcacagaggagggcgcgaatgtcgccctgctggtaattgatgccgtatttattgaacagttccttgtaggcggatgtcaggcacacttcctcccagtcaaagacgttatttttttttggattcctgaagatgcggatcctgttcccgtaggagtacagcttccacttcttgatgtaatccgcatctgtgcggctgaagtttttgtagtcgagggcgaactcgaagaggtcctcctccggcacatacataatgcggtcgaaggaggagataaacttcttgctgtcggcaatggaggtatactttgtcttcaggaggttcacgaagccggtgctcgggtcaatcttggaggtgagccacgccgggatgtagaaaataaacccgttctgggtgctcatgctcttgaagctctcgaacttgttggtgatctgatagcccttcagcgcgccccctgtggcacacgggttggacttcttatccaccatataattgagtttgtcgatcagcattttctcgaatttctgatacacctgtttttccaccttcacgcgggagttcttgaacccagaatttaagtcttcgagcgcaatcacggcgtcatatttctccaccagctcgcagatcttgtggacgacttgggaaatatagccggcctttaattctttgatattctcaatggaggtccagttttggcgggcctcaaacctctctttttctttcttgtcgagcaggctgtgatagtcggtcttaatcctaatcccattgaagttgttgataatctcgttcagggagtactgctccacaatattgcccttcccatccacgaccacgatatagagcagattgcgctcgcccctgtcaatgccgatgacatacggattgtcgtcgtgtttgagcagcaccctgacctctgtattaattttgaagatattctttgggcacttattaatcgcaattgggatgtgtaattcgtactggtcttcgctgaagcgtttgtccttgtagacgtcgtaggacagggtggtggtctttttcggattgtccgggttcttgttcgcgatcggggaattggctggatggacgaccagctcttccttcttgagggaggccctgcgcatgaataattcggcgccgccgctcagcctgatttgcccgtggttgttctcgtcaaagagcagtttgaagtacatggtgtggaggtttggggtcccatggctcttgtcggaaaagtccttgttataaatttggaacatgtagagcttgccctcctcgacgagcttgtcgacttccttcttgctcgcggattcaaaagaaactttatacccttgctcctccacctccctgtaaaagcccgcgatgtctttgtacttttctgtctcggagaagttaaaatcgtacgcattggaccatttcgggtagcgggaaatgctatccttgaagaaatcaatgagcttgtggcagtcgttgaggttaaacatgtcccccttcttgaaggtcccgtttttatagattttctgaatatcctcgcttggattgtagtaggccatccacttcttgctgaagaacaccttcgggagcatcttgttcggacccggcagcagcttgtagttgatcttttcatagttgccattgacgtcgtctttgtcgatcttctgcaggcacttcgcgtacttcttgtccatgatggccagatagtatttggagccatagcggagaattgtcgcgcggtagtctgtctctttatccttgtcccagccccccataaattgcgggttctggaagtacagcttgaacttgtctttggagtacggcttctgtgtcacgtagttgcggatcgcgtcgtaaatgtggtcgaccttcagcaggatgtcgtacgcgaggacaaagtcgccatagaaggactcatccctgttagtttccttcccctccccaaagaacgctttaatgtaattttcgaaggacttcacggagtcgagcaggtctttcataatggccaccacggcgtcattctttttgagggacttctcgagcacaaagtcggcgtcgaacagcttctcgctggacccgtacactttatagatctcgtcgaccttctgaatgatgatttccttcagcttctcgacgacggacagatccgcatcggcatactcctggagctgttcgaggctgaaggagccgatttttttgaaggacttcctgcgatcgtcctcatacttctcggtcaccaccgccttcttcttcaggtggatgtcgtcgtactcggcgttccacttgtccctgatgacgttccactcgccaaagatgtccttggagatggtgctgatcgccggcccgttcttcacgaaaatcccggcggagctgtactcgtcaaagttcttaaagagcttctcgagcttcttgatggaggagaaaatctcgctattcttattcagtgtgttgcggaagacttccagcacctcctcgtcgctggtatagccctcgccgtagaaggagaggctttccctatcggacaggacttgcttgtagagcggcttgaatttcggcagtttctgcttggtcttctgattgtacagattgatgtactcattcagccccttaatcttctccccggactctgtgacgaagcccccgataatcgcgttgtacacgtcaatgccctcttgtgtgagcacaaaattaaagaactccccttcgaagaaatcctcgacgtcataatcggaattgagaatcttctctttgatctcctgcacctcgtgcttatcgaagatcgcatccaccttctcgaaaatgtccatattggaaatgtagcgggtgaggttctcgttgatacacctgaaggcgatgctggtggacttggcctcctcggagaacatattttccctgttatcaaagaagccggtaaacgcggttgtgaacccgttaaaggagttcaccagcgcgatctcgtccttgtcatcgagaaactctgggaggatagtttcgatgatgtctttcttgaagaggctcttgtacccttcattgcccttgaacgctttggcgatttccttgcggaggttgatctccaggttctccagctccttgttctccttctcggtgcgggtctttttgcggaagagggagatgtagttgttgagattcttgagtttgatgctgtgcagcacgtcgttaataaagctgaggtagtacctatcgagcagcttcttcacgcccttgtagtcttcggcgcgcttctcgtcttccaccaggagcctcttgttgtcgatgttctcctgggtcttgcccaccgggatcgctttaaacctgagggttttggagaggctgtaacagtttgtaaacttctccagcttggacgccataccctgtataatccaaaacaaagaaaaacaaatgaatcaatcaccaatttttcattgtgtgtacaacaaggttaaaagaatatgggttatgaaaactggaagcagcagatcagcaattataatcaattcaatttacaacagacatcaaaaaaacttgctcatcaaattctccctgacaatcaataaatcgggtaaaaaatatccatgtactaatctaattaaaggacgtattttttgaatcatacaatacaaaaatccaaatctaaaaatttatatgaacccctaatcacaatctaaagactgtctttgaaaaacaaaggattaaatcatacaataaacagtaaaatcaagtaaacggttcaattcagaaggatttcaatcagatgaaagaaaagaacaaaaccctaattgaatttaaatttgacggatcaaaagaaaagatcgattaaacgatagtagctaataataataaaataatcgaagaatagaaagtagattataccttgaaacggaattgggtgctaggtttgaatgaatctcttttccaaaggaaccggttttgtagcgatggggaagaaaagaatgaagaagtttagtttacctgatttgcttttatagcaaaaatcgattggctgttatattacgccaacggcacctcttccaattaaaacgtgacacgtggacaaactgtgacttgttacctaaccctttgtgatacgacaacgtttggtataagagagtccacgtctattatatgctgtcttgcaccgcctcgagacaattcttctaactaagatcgattgtgatacaggtgcgggtacaatacaatacgggtacgtgaattagcggtttttaaaaaaaaattaagatacgatacggtaatgacttatgatacgttaacaatgatttataataaaacttatatttgaagaaaaattaacactgattactctttattattgtattattataaaagatacaatttttaaaaaatagtacatgtgattattaaaataaattttttaaaaattttcttataaatcatattacattttcatatgatgtgatattgagagaaacatcattaaaagaacttaacattaattttatttaatgttgtctaactgaatcacctctctcgctacgttcttccacaagaaatataattttaagtgtttcatcgagaatcaattatactgatgcatatctaaaattgaatcatatacatttataatgaatttttacaacattgtctcacttttttactcttcatgtttttctaggatacgtatctataaagtatcttagaaatatccttgtgtatatgtagagtatcacataagtatccgataaaatatttattaaaaattaaaataattaatatgatacttcgtgcgtacgtatccgatatgagtaagtctctgtattgaagtatacaggtttcatagctgatacatctctttcacggttttgtctaatgtacccaaatcataagtaaaatagtattgcgtcataaactagtgtgtgttttttattttcacgtgtccgtcttttcgtttttttagtgcgctgacgtttaaaaattattaacagtggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 136 - DNA, 7267 bp, Artificial Sequence
  pWISE3123 Full Plasmid Sequence
ccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtgggggctcctcgggtggcagcatgagcggatcaaaaaaaagaaggatcaagcaagatccgccgccagcgctgccgcccaagcgccgtcgctccggcggtagcagcggtggttccccgccgccggctctgccgccgaagcgccgtagaagcggcggttcaagcggtggctctccgccaccggcactgcctccgaaacgtcgtcgttctggcggtagcagcggtggctcgccgccgccggcgttgccgccgaaacgccgtcgttccggtagtggggggtcctctggtggaagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgc

SEQ ID NO: 137 - DNA, 18472 bp, Artificial Sequence
  pWISE3090 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccattgggatcctgcagggagccactgaaattctgtaagaactacattcgccgtgagtttgacataatcacaacgagccactgaaattttgtaaaaactacacttaagagcttcaacaaaatcagtgtcacggtaatttttgtcaaaattcactaattcaaaagctaatgccaaaaattggcaatgactcaactcaagaatctcatcttccacagggtaagctgttaccataaggtgagaacataatagaatttgataattgaaattttgcattgcaaggcattattaccaagagaagtctatgccaaagccacaacactaaacagatgtattaagcccaaagggagacacaaagaagctacaaacaagtacttattgcttttacatcatcacgataagctttggttcagtactaacatcagcaattaaaaggccacacaataagagatgttctcatggtcataattgtaattacagagctcaataatgaaagtatgaaatcatgacagagagccctttcagtgcttcacggaggtctgcgcgtactccagccactccttgttggaaatggcaattttcaccttgtcgagcttctcatcctccgcctttttgaactgcccgatggcccagagcactttcctggcgatattataggccccgttcgcatcggcgttcttcgggaggatcgcattctcttgcgcctcatagttgcgggagtcgtaaaagatcccgtcggagttcttcaccgggctgatgaggaagtcgacgtcggtgcgccctgtgatgctattcctcatttggagcatcagggacatgagggccatgaagctggagtaaaacgctttgtcggactgctcacagaggagggcgcgaatgtcgccctgctggtaattgatgccgtatttattgaacagttccttgtaggcggatgtcaggcacacttcctcccagtcaaagacgttatttttttttggattcctgaagatgcggatcctgttcccgtaggagtacagcttccacttcttgatgtaatccgcatctgtgcggctgaagtttttgtagtcgagggcgaactcgaagaggtcctcctccggcacatacataatgcggtcgaaggaggagataaacttcttgctgtcggcaatggaggtatactttgtcttcaggaggttcacgaagccggtgctcgggtcaatcttggaggtgagccacgccgggatgtagaaaataaacccgttctgggtgctcatgctcttgaagctctcgaacttgttggtgatctgatagcccttcagcgcgccccctgtggcacacgggttggacttcttatccaccatataattgagtttgtcgatcagcattttctcgaatttctgatacacctgtttttccaccttcacgcgggagttcttgaacccagaatttaagtcttcgagcgcaatcacggcgtcatatttctccaccagctcgcagatcttgtggacgacttgggaaatatagccggcctttaattctttgatattctcaatggaggtccagttttggcgggcctcaaacctctctttttctttcttgtcgagcaggctgtgatagtcggtcttaatcctaatcccattgaagttgttgataatctcgttcagggagtactgctccacaatattgcccttcccatccacgaccacgatatagagcagattgcgctcgcccctgtcaatgccgatgacatacggattgtcgtcgtgtttgagcagcaccctgacctctgtattaattttgaagatattctttgggcacttattaatcgcaattgggatgtgtaattcgtactggtcttcgctgaagcgtttgtccttgtagacgtcgtaggacagggtggtggtctttttcggattgtccgggttcttgttcgcgatcggggaattggctggatggacgaccagctcttccttcttgagggaggccctgcgcatgaataattcggcgccgccgctcagcctgatttgcccgtggttgttctcgtcaaagagcagtttgaagtacatggtgtggaggtttggggtcccatggctcttgtcggaaaagtccttgttataaatttggaacatgtagagcttgccctcctcgacgagcttgtcgacttccttcttgctcgcggattcaaaagaaactttatacccttgctcctccacctccctgtaaaagcccgcgatgtctttgtacttttctgtctcggagaagttaaaatcgtacgcattggaccatttcgggtagcgggaaatgctatccttgaagaaatcaatgagcttgtggcagtcgttgaggttaaacatgtcccccttcttgaaggtcccgtttttatagattttctgaatatcctcgcttggattgtagtaggccatccacttcttgctgaagaacaccttcgggagcatcttgttcggacccggcagcagcttgtagttgatcttttcatagttgccattgacgtcgtctttgtcgatcttctgcaggcacttcgcgtacttcttgtccatgatggccagatagtatttggagccatagcggagaattgtcgcgcggtagtctgtctctttatccttgtcccagccccccataaattgcgggttctggaagtacagcttgaacttgtctttggagtacggcttctgtgtcacgtagttgcggatcgcgtcgtaaatgtggtcgaccttcagcaggatgtcgtacgcgaggacaaagtcgccatagaaggactcatccctgttagtttccttcccctccccaaagaacgctttaatgtaattttcgaaggacttcacggagtcgagcaggtctttcataatggccaccacggcgtcattctttttgagggacttctcgagcacaaagtcggcgtcgaacagcttctcgctggacccgtacactttatagatctcgtcgaccttctgaatgatgatttccttcagcttctcgacgacggacagatccgcatcggcatactcctggagctgttcgaggctgaaggagccgatttttttgaaggacttcctgcgatcgtcctcatacttctcggtcaccaccgccttcttcttcaggtggatgtcgtcgtactcggcgttccacttgtccctgatgacgttccactcgccaaagatgtccttggagatggtgctgatcgccggcccgttcttcacgaaaatcccggcggagctgtactcgtcaaagttcttaaagagcttctcgagcttcttgatggaggagaaaatctcgctattcttattcagtgtgttgcggaagacttccagcacctcctcgtcgctggtatagccctcgccgtagaaggagaggctttccctatcggacaggacttgcttgtagagcggcttgaatttcggcagtttctgcttggtcttctgattgtacagattgatgtactcattcagccccttaatcttctccccggactctgtgacgaagcccccgataatcgcgttgtacacgtcaatgccctcttgtgtgagcacaaaattaaagaactccccttcgaagaaatcctcgacgtcataatcggaattgagaatcttctctttgatctcctgcacctcgtgcttatcgaagatcgcatccaccttctcgaaaatgtccatattggaaatgtagcgggtgaggttctcgttgatacacctgaaggcgatgctggtggacttggcctcctcggagaacatattttccctgttatcaaagaagccggtaaacgcggttgtgaacccgttaaaggagttcaccagcgcgatctcgtccttgtcatcgagaaactctgggaggatagtttcgatgatgtctttcttgaagaggctcttgtacccttcattgcccttgaacgctttggcgatttccttgcggaggttgatctccaggttctccagctccttgttctccttctcggtgcgggtctttttgcggaagagggagatgtagttgttgagattcttgagtttgatgctgtgcagcacgtcgttaataaagctgaggtagtacctatcgagcagcttcttcacgcccttgtagtcttcggcgcgcttctcgtcttccaccaggagcctcttgttgtcgatgttctcctgggtcttgcccaccgggatcgctttaaacctgagggttttggagaggctgtaacagtttgtaaacttctccagcttggagctgccggagccgccggagccgccctcgggcgtcgcgctctcggaggtgcctggtgtctcggaggagccgtacttctccacataagggacaggaatcattcctctcttcccttcagaatcttcagcattccaccattgttcttctggtttgtcccttattcggaggatgtcacctttcttgaagggcaaatcctcttcatcattgccgttaaaatcaaaaagggcacgaacatactctgccgccataccctgtataatccaaaacaaagaaaaacaaatgaatcaatcaccaatttttcattgtgtgtacaacaaggttaaaagaatatgggttatgaaaactggaagcagcagatcagcaattataatcaattcaatttacaacagacatcaaaaaaacttgctcatcaaattctccctgacaatcaataaatcgggtaaaaaatatccatgtactaatctaattaaaggacgtattttttgaatcatacaatacaaaaatccaaatctaaaaatttatatgaacccctaatcacaatctaaagactgtctttgaaaaacaaaggattaaatcatacaataaacagtaaaatcaagtaaacggttcaattcagaaggatttcaatcagatgaaagaaaagaacaaaaccctaattgaatttaaatttgacggatcaaaagaaaagatcgattaaacgatagtagctaataataataaaataatcgaagaatagaaagtagattataccttgaaacggaattgggtgctaggtttgaatgaatctcttttccaaaggaaccggttttgtagcgatggggaagaaaagaatgaagaagtttagtttacctgatttgcttttatagcaaaaatcgattggctgttatattacgccaacggcacctcttccaattaaaacgtgacacgtggacaaactgtgacttgttacctaaccctttgtgatacgacaacgtttggtataagagagtccacgtctattatatgctgtcttgcaccgcctcgagacaattcttctaactaagatcgattgtgatacaggtgcgggtacaatacaatacgggtacgtgaattagcggtttttaaaaaaaaattaagatacgatacggtaatgacttatgatacgttaacaatgatttataataaaacttatatttgaagaaaaattaacactgattactctttattattgtattattataaaagatacaatttttaaaaaatagtacatgtgattattaaaataaattttttaaaaattttcttataaatcatattacattttcatatgatgtgatattgagagaaacatcattaaaagaacttaacattaattttatttaatgttgtctaactgaatcacctctctcgctacgttcttccacaagaaatataattttaagtgtttcatcgagaatcaattatactgatgcatatctaaaattgaatcatatacatttataatgaatttttacaacattgtctcacttttttactcttcatgtttttctaggatacgtatctataaagtatcttagaaatatccttgtgtatatgtagagtatcacataagtatccgataaaatatttattaaaaattaaaataattaatatgatacttcgtgcgtacgtatccgatatgagtaagtctctgtattgaagtatacaggtttcatagctgatacatctctttcacggttttgtctaatgtacccaaatcataagtaaaatagtattgcgtcataaactagtgtgtgttttttattttcacgtgtccgtcttttcgtttttttagtgcgctgacgtttaaaaattattaacagtggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 138 - DNA, 22 bp, Artificial Sequence
  aadA specific primer for first strand synthesis
atttgccgactaccttggtgat

SEQ ID NO: 139 - DNA, 12796 bp, Artificial Sequence
  pWISE3899 Full Plasmid Sequence
cggtgcctaatgagtgagctaacttacattaattgcgttgcgccccgagagcgttcaccgacaaacaacagataaaacgaaaggcccagtctttcgactgagcctttcgttttatttgatgcctggttacctcgaaagcccgctgcgcgagcggtcacgcgatgaggcatccagctccgctcgggtgcggttatagacctcattgatatttttctcgaaggattcgtttgtcgtcagaaggcccactgcgttagggccgcctctggcgaggctggccgaagagccaccactgctgccgcccgaatcctgtttgatccgacgcttcttgctaccagcagaataaatgccggagttcgcggcaatagcggacgggatcggatttccatccttgaggaggccctgcatcgccttgacgatcaattcgcagtcggagttcgttgcgaatatcgggatggtgagttccatgttcaggtagctgcgccaggccgccaccggcagttcaacgccgcccacggtctgcgtcgcaactttgggaacctcgaccttgatggtgtacttccgcttctgggccgatgactggcggacggagcaggtcactttatacgcttgggaccgcgagttgctggagatccattccgccactccattggcaaaattcgagggggctacggtgacatcacccgtaccgccgttgtcgaccaggacgaattgagtgaaattgctggcgtcctgcttgatgcggcgcttcttggacccgctcatggtacctccccatctccccaagctcataaccaacacagccacttcggtcggaagaaatgctgtcatctgatgttcacgattatcgggagggtcggttactctaggatttttgttttcttcttttcgatttcatttgaagcgaaaacggctttccatgcacttaagggtgcgccgacgaaagatggctctctaagacaacggcgaggatctagaatgccgtcgaagtgaaattccagggcggaatgaacgggggatggttccaataaactgtggcacttcgcaggctccgatcagggtgtcgatcgcgccatttgcgtggcgagggtatccgcctatgccgactatcctatgtccgagctcagcgaacatatgtcttgttcttcgaagacggtatcgaagacctccagcagataatcgccaaccttcgggtctcagaagacgcaccgccacaaccgactgcccaaagcgattgcgagaaaccatagctataggcgcgccgaacagacgtgctgattaccctggtcgagtctccttaattaacaaaaaacccctcaagacccgtttagaggccccaaggggttatgctagttattgctcagcggaatctacacttagtagaaattagggaacacgagcgacatgggtgatcctcatgtcgctcgtggcacatgggtgatcctcatgtgctccccttggactctcaaattaacggcaatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 140 - DNA, 12796 bp, Artificial Sequence
  pWISE3900 Full Plasmid Sequence
cggtgcctaatgagtgagctaacttacattaattgcgttgcgccccgagagcgttcaccgacaaacaacagataaaacgaaaggcccagtctttcgactgagcctttcgttttatttgatgcctggttacctcgaaagcccgctgcgcgagcggtcacgcgatgaggcatccagctccgctcgggtgcggttatagacctcattgatatttttctcgaaggattcgtttgtcgtcagaaggcccactgcgttagggccgcctctggcgaggctggccgaagagccaccactgctgccgcccgaatcctgtttgatccgacgcttcttgctaccagcagaataaatgccggagttcgcggcaatagcggacgggatcggatttccatccttgaggaggccctgcatcgccttgacgatcaattcgcagtcggagttcgttgcgaatatcgggatggtgagttccatgttcaggtagctgcgccaggccgccaccggcagttcaacgccgcccacggtctgcgtcgcaactttgggaacctcgaccttgatggtgtacttccgcttctgggccgatgactggcggacggagcaggtcactttatacgcttgggaccgcgagttgctggagatccattccgccactccattggcaaaattcgagggggctacggtgacatcacccgtaccgccgttgtcgaccaggacgaattgagtgaaattgctggcgtcctgcttgatgcggcgcttcttggacccgctcatggtacctccccatctccccaagctcataaccaacacagccacttcggtcggaagaaatgctgtcatctgatgttcacgattatcgggagggtcggttactctaggatttttgttttcttcttttcgatttcatttgaagcgaaaacggctttccatgcacttaagggtgcgccgacgaaagatggctctctaagacaacggcgaggatctagaatgccgtcgaagtgaaattccagggcggaatgaacgggggatggttccaataaactgtggcacttcgcaggctccgatcagggtgtcgatcgcgccatttgcgtggcgagggtatccgcctatgccgactatcctatgtccgagctcagcgaacatatgtcttgttcttcgaagacggtatcgaagacctccagcagataatcgccaaccttcgggtctcagaagacgcaccgccacaaccgactgcccaaagcgattgcgagaaaccatagctataggcgcgccgaacagacgtgctgattaccctggtcgagtctccttaattaacaaaaaacccctcaagacccgtttagaggccccaaggggttatgctagttattgctcagcggaatctacacttagtagaaattagggaacacgagcgacatgggtgatcctcatgtcgctcgtggcacatgggtgatcctcatgtgctcccgctcgaggtcttcgttgggaactatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 141 - DNA, 26 bp, Artificial Sequence
  Polyubiquitin left flank primer
tgctcaggtcctttagcaactacctt

SEQ ID NO: 142 - DNA, 25 bp, Artificial Sequence
  Polyubiquitin right flank primer
ggagaaacatgtgagtagaccactt

SEQ ID NO: 143 - DNA, 11481 bp, Artificial Sequence
  pWISE3897 Full Plasmid Sequence
cggtgcctaatgagtgagctaacttacattaattgcgttgcgccccttaattaacaaaaaacccctcaagacccgtttagaggccccaaggggttatgctagttattgctcagcggaatctacacttagtagaaattatatccacatgtgtttttagtaaaatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 144 - DNA, 11481 bp, Artificial Sequence
  pWISE3898 Full Plasmid Sequence
cggtgcctaatgagtgagctaacttacattaattgcgttgcgccccttaattaacaaaaaacccctcaagacccgtttagaggccccaaggggttatgctagttattgctcagcggaatctacacttagtagaaattacatggagggcacagttaagccgcatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 145 - DNA, 12796 bp, Artificial Sequence
  pWISE3901 Full Plasmid Sequence
cggtgcctaatgagtgagctaacttacattaattgcgttgcgccccgagagcgttcaccgacaaacaacagataaaacgaaaggcccagtctttcgactgagcctttcgttttatttgatgcctggttacctcgaaagcccgctgcgcgagcggtcacgcgatgaggcatccagctccgctcgggtgcggttatagacctcattgatatttttctcgaaggattcgtttgtcgtcagaaggcccactgcgttagggccgcctctggcgaggctggccgaagagccaccactgctgccgcccgaatcctgtttgatccgacgcttcttgctaccagcagaataaatgccggagttcgcggcaatagcggacgggatcggatttccatccttgaggaggccctgcatcgccttgacgatcaattcgcagtcggagttcgttgcgaatatcgggatggtgagttccatgttcaggtagctgcgccaggccgccaccggcagttcaacgccgcccacggtctgcgtcgcaactttgggaacctcgaccttgatggtgtacttccgcttctgggccgatgactggcggacggagcaggtcactttatacgcttgggaccgcgagttgctggagatccattccgccactccattggcaaaattcgagggggctacggtgacatcacccgtaccgccgttgtcgaccaggacgaattgagtgaaattgctggcgtcctgcttgatgcggcgcttcttggacccgctcatggtacctccccatctccccaagctcataaccaacacagccacttcggtcggaagaaatgctgtcatctgatgttcacgattatcgggagggtcggttactctaggatttttgttttcttcttttcgatttcatttgaagcgaaaacggctttccatgcacttaagggtgcgccgacgaaagatggctctctaagacaacggcgaggatctagaatgccgtcgaagtgaaattccagggcggaatgaacgggggatggttccaataaactgtggcacttcgcaggctccgatcagggtgtcgatcgcgccatttgcgtggcgagggtatccgcctatgccgactatcctatgtccgagctcagcgaacatatgtcttgttcttcgaagacggtatcgaagacctccagcagataatcgccaaccttcgggtctcagaagacgcaccgccacaaccgactgcccaaagcgattgcgagaaaccatagctataggcgcgccgaacagacgtgctgattaccctggtcgagtctccttaattaacaaaaaacccctcaagacccgtttagaggccccaaggggttatgctagttattgctcagcggaatctacacttagtagaaattagggaacacgagcgacatgggtgatcctcatgtcgctcgtggcacatgggtgatcctcatgtgctccctatccacatgtgtttttagtaaaatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 146 - DNA, 12796 bp, Artificial Sequence
  pWISE3902 Full Plasmid Sequence
cggtgcctaatgagtgagctaacttacattaattgcgttgcgccccgagagcgttcaccgacaaacaacagataaaacgaaaggcccagtctttcgactgagcctttcgttttatttgatgcctggttacctcgaaagcccgctgcgcgagcggtcacgcgatgaggcatccagctccgctcgggtgcggttatagacctcattgatatttttctcgaaggattcgtttgtcgtcagaaggcccactgcgttagggccgcctctggcgaggctggccgaagagccaccactgctgccgcccgaatcctgtttgatccgacgcttcttgctaccagcagaataaatgccggagttcgcggcaatagcggacgggatcggatttccatccttgaggaggccctgcatcgccttgacgatcaattcgcagtcggagttcgttgcgaatatcgggatggtgagttccatgttcaggtagctgcgccaggccgccaccggcagttcaacgccgcccacggtctgcgtcgcaactttgggaacctcgaccttgatggtgtacttccgcttctgggccgatgactggcggacggagcaggtcactttatacgcttgggaccgcgagttgctggagatccattccgccactccattggcaaaattcgagggggctacggtgacatcacccgtaccgccgttgtcgaccaggacgaattgagtgaaattgctggcgtcctgcttgatgcggcgcttcttggacccgctcatggtacctccccatctccccaagctcataaccaacacagccacttcggtcggaagaaatgctgtcatctgatgttcacgattatcgggagggtcggttactctaggatttttgttttcttcttttcgatttcatttgaagcgaaaacggctttccatgcacttaagggtgcgccgacgaaagatggctctctaagacaacggcgaggatctagaatgccgtcgaagtgaaattccagggcggaatgaacgggggatggttccaataaactgtggcacttcgcaggctccgatcagggtgtcgatcgcgccatttgcgtggcgagggtatccgcctatgccgactatcctatgtccgagctcagcgaacatatgtcttgttcttcgaagacggtatcgaagacctccagcagataatcgccaaccttcgggtctcagaagacgcaccgccacaaccgactgcccaaagcgattgcgagaaaccatagctataggcgcgccgaacagacgtgctgattaccctggtcgagtctccttaattaacaaaaaacccctcaagacccgtttagaggccccaaggggttatgctagttattgctcagcggaatctacacttagtagaaattagggaacacgagcgacatgggtgatcctcatgtcgctcgtggcacatgggtgatcctcatgtgctccccatggagggcacagttaagccgcatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggaggtaccatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccaccggaaggagctgactgggttgaaggctctcaagggcatcggtcgagatcc

SEQ ID NO: 147 - DNA, 11110 bp, Artificial Sequence
  pWISE3905 Full Plasmid Sequence
gcccaccggaaggagctgactgggttgaaggctctcaagggcatcggtcgagatcccggtgcctaatgagtgagctaacttacattaattgcgttgcgccccttaattaacaaaaaacccctcaagacccgtttagaggccccaaggggttatgctagttattgctcagcggaatctacacttagtagaaattatatccacatgtgtttttagtaaaatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgc

SEQ ID NO: 148 - DNA, 11110 bp, Artificial Sequence
  pWISE3906 Full Plasmid Sequence
gcccaccggaaggagctgactgggttgaaggctctcaagggcatcggtcgagatcccggtgcctaatgagtgagctaacttacattaattgcgttgcgccccttaattaacaaaaaacccctcaagacccgtttagaggccccaaggggttatgctagttattgctcagcggaatctacacttagtagaaattacatggagggcacagttaagccgcatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgc

SEQ ID NO: 149 - DNA, 28 bp, Polyubiquitin left flank primer
gttgattctgtagtcgtagattaaggtt

SEQ ID NO: 150 - DNA, 12425 bp, Artificial Sequence
  pWISE3910 Full Plasmid Sequence
gcccaccggaaggagctgactgggttgaaggctctcaagggcatcggtcgagatcccggtgcctaatgagtgagctaacttacattaattgcgttgcgccccgagagcgttcaccgacaaacaacagataaaacgaaaggcccagtctttcgactgagcctttcgttttatttgatgcctggttacctcgaaagcccgctgcgcgagcggtcacgcgatgaggcatccagctccgctcgggtgcggttatagacctcattgatatttttctcgaaggattcgtttgtcgtcagaaggcccactgcgttagggccgcctctggcgaggctggccgaagagccaccactgctgccgcccgaatcctgtttgatccgacgcttcttgctaccagcagaataaatgccggagttcgcggcaatagcggacgggatcggatttccatccttgaggaggccctgcatcgccttgacgatcaattcgcagtcggagttcgttgcgaatatcgggatggtgagttccatgttcaggtagctgcgccaggccgccaccggcagttcaacgccgcccacggtctgcgtcgcaactttgggaacctcgaccttgatggtgtacttccgcttctgggccgatgactggcggacggagcaggtcactttatacgcttgggaccgcgagttgctggagatccattccgccactccattggcaaaattcgagggggctacggtgacatcacccgtaccgccgttgtcgaccaggacgaattgagtgaaattgctggcgtcctgcttgatgcggcgcttcttggacccgctcatggtacctccccatctccccaagctcataaccaacacagccacttcggtcggaagaaatgctgtcatctgatgttcacgattatcgggagggtcggttactctaggatttttgttttcttcttttcgatttcatttgaagcgaaaacggctttccatgcacttaagggtgcgccgacgaaagatggctctctaagacaacggcgaggatctagaatgccgtcgaagtgaaattccagggcggaatgaacgggggatggttccaataaactgtggcacttcgcaggctccgatcagggtgtcgatcgcgccatttgcgtggcgagggtatccgcctatgccgactatcctatgtccgagctcagcgaacatatgtcttgttcttcgaagacggtatcgaagacctccagcagataatcgccaaccttcgggtctcagaagacgcaccgccacaaccgactgcccaaagcgattgcgagaaaccatagctataggcgcgccgaacagacgtgctgattaccctggtcgagtctccttaattaacaaaaaacccctcaagacccgtttagaggccccaaggggttatgctagttattgctcagcggaatctacacttagtagaaattagggaacacgagcgacatgggtgatcctcatgtcgctcgtggcacatgggtgatcctcatgtgctccctatccacatgtgtttttagtaaaatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgc

SEQ ID NO: 151 - DNA, 12425 bp, Artificial Sequence
  pWISE3911 Full Plasmid Sequence
gcccaccggaaggagctgactgggttgaaggctctcaagggcatcggtcgagatcccggtgcctaatgagtgagctaacttacattaattgcgttgcgccccgagagcgttcaccgacaaacaacagataaaacgaaaggcccagtctttcgactgagcctttcgttttatttgatgcctggttacctcgaaagcccgctgcgcgagcggtcacgcgatgaggcatccagctccgctcgggtgcggttatagacctcattgatatttttctcgaaggattcgtttgtcgtcagaaggcccactgcgttagggccgcctctggcgaggctggccgaagagccaccactgctgccgcccgaatcctgtttgatccgacgcttcttgctaccagcagaataaatgccggagttcgcggcaatagcggacgggatcggatttccatccttgaggaggccctgcatcgccttgacgatcaattcgcagtcggagttcgttgcgaatatcgggatggtgagttccatgttcaggtagctgcgccaggccgccaccggcagttcaacgccgcccacggtctgcgtcgcaactttgggaacctcgaccttgatggtgtacttccgcttctgggccgatgactggcggacggagcaggtcactttatacgcttgggaccgcgagttgctggagatccattccgccactccattggcaaaattcgagggggctacggtgacatcacccgtaccgccgttgtcgaccaggacgaattgagtgaaattgctggcgtcctgcttgatgcggcgcttcttggacccgctcatggtacctccccatctccccaagctcataaccaacacagccacttcggtcggaagaaatgctgtcatctgatgttcacgattatcgggagggtcggttactctaggatttttgttttcttcttttcgatttcatttgaagcgaaaacggctttccatgcacttaagggtgcgccgacgaaagatggctctctaagacaacggcgaggatctagaatgccgtcgaagtgaaattccagggcggaatgaacgggggatggttccaataaactgtggcacttcgcaggctccgatcagggtgtcgatcgcgccatttgcgtggcgagggtatccgcctatgccgactatcctatgtccgagctcagcgaacatatgtcttgttcttcgaagacggtatcgaagacctccagcagataatcgccaaccttcgggtctcagaagacgcaccgccacaaccgactgcccaaagcgattgcgagaaaccatagctataggcgcgccgaacagacgtgctgattaccctggtcgagtctccttaattaacaaaaaacccctcaagacccgtttagaggccccaaggggttatgctagttattgctcagcggaatctacacttagtagaaattagggaacacgagcgacatgggtgatcctcatgtcgctcgtggcacatgggtgatcctcatgtgctccccatggagggcacagttaagccgcatctacacttagtagaaattatttaatctttgaaacgctagcattatacctaggactgagctagctgtcaacaattggggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggctccaagaagcgccgcatcaagcaagattcaaagctggagaagttcaccaactgctactcgctgagcaagacgctgcggttcaaggccatccccgtgggcaagacccaggagaacatcgacaacaagcgcctcctggtcgaggacgagaagcgcgccgaggactacaagggcgtcaagaagctcctggaccggtattacctcagcttcatcaacgacgtgctgcactcgatcaagctcaagaacctgaacaactacatcagcctgttccgcaagaaaacgcgcaccgagaaggagaacaaagagctggagaacctggagatcaacctgcggaaggagattgcgaaagctttcaagggcaacgagggctacaagtcgctcttcaagaaagacataatcgagaccatcctgccggagttcctggacgacaaggacgagatcgcgctcgtcaactcgttcaacgggttcactacggccttcacgggtttcttcgataaccgggagaatatgtttagcgaggaggccaagtccacctccattgcgttccgctgcatcaacgagaacctgacccgctacatcagcaacatggacatcttcgagaaggtggacgccatcttcgacaagcacgaggtccaggagatcaaggagaagattctgaactcggactacgacgtggaagacttcttcgagggcgagtttttcaacttcgtcctgacccaggaggggatcgacgtttataacgccatcatcggcgggttcgtcacggagtcgggcgaaaagatcaagggcctgaacgagtatattaacctgtacaaccagaagacaaagcagaagctgccgaagttcaagccgctgtacaagcaagtcctgtccgaccgcgagtcgctgtcgttctacggcgaaggctacacctcggacgaggaggtgctggaggtgttccgcaacaccctgaacaagaatagcgaaatttttagctccattaagaagctcgagaagctgttcaagaacttcgacgagtacagcagcgccgggatcttcgtcaagaacggccccgcgatcagcaccatctcgaaggacatcttcggcgagtggaacgtcatccgggacaagtggaacgccgagtacgacgacattcaccttaaaaagaaggctgttgtgacggagaagtacgaggacgaccggcgcaagtcgttcaaaaagatcggctccttctccctggagcagctccaggagtacgccgacgccgacctctcggtcgtcgagaagctcaaggagatcatcattcagaaggtggacgaaatttacaaagtgtacggctccagcgagaagctgttcgacgccgacttcgtgctggaaaagtcgctcaagaaaaacgacgccgtggtggccatcatgaaggacttgctggacagcgtgaagtcgttcgagaactacattaaggcgttctttggcgagggcaaggagaccaaccgcgacgagtcgttctacggcgacttcgtgctcgcgtacgacatcctgctcaaggtggatcacatctacgacgcgatccgcaactacgtcacgcagaagccgtactcgaaggacaagttcaagctgtacttccagaacccgcagttcatgggcgggtgggacaaggacaaggaaacggactaccgcgcgaccatcctgcggtacggcagcaagtattatctggcgatcatggacaaaaaatatgccaagtgcctccagaaaatcgacaaggacgacgtgaacggcaactacgagaagattaattacaagctgctccccggccccaacaagatgctcccgaaggtgttctttagcaagaagtggatggcctactacaacccgagcgaggacatccagaagatctataagaatggcaccttcaagaagggagacatgtttaacctcaacgactgccacaagctgattgacttcttcaaggactcgatctcgcgctacccgaagtggtcgaacgcctacgacttcaacttcagcgaaacggagaaatacaaagacatcgcgggcttctaccgcgaggtcgaggagcaaggctacaaggtcagcttcgagtccgccagcaagaaggaggtggacaagctggtggaggagggcaagctctacatgtttcagatctacaacaaggattttagcgacaagtcgcacggcacgccgaacctgcacacgatgtacttcaagctgctgttcgacgagaacaaccacggccagatccggctgtcgggcggtgcggagctgttcatgcgccgggcgtcgctcaagaaggaagagctggtcgtccacccggccaacagccccatcgccaacaagaaccccgacaaccccaagaaaacgacgacactcagctatgatgtctataaagacaagcgcttctcggaggaccagtacgagctgcacatccccatcgccatcaacaagtgccccaagaacatcttcaagatcaacacggaggtccgcgtgctcctcaagcacgacgacaacccgtacgtcatcggcatcgaccggggcgagcgcaacctgctgtacatcgtcgtcgtcgatggcaagggcaacatcgtggagcagtattccctgaacgagatcatcaacaacttcaacggcatccgcatcaagaccgactaccactccctcctcgacaagaaggagaaagagcgcttcgaggcccgccagaactggacctccatcgagaacatcaaggagcttaaggcgggctacatctcccaagtcgtccacaagatctgcgagctggtcgagaagtacgacgcggtgatcgccctggaagacctgaactccggcttcaagaactcccgcgtaaaggtggagaagcaagtgtaccagaagttcgagaagatgctgatcgacaagctgaactacatggtggacaagaaatcgaacccgtgcgcgaccggcggcgcgctcaagggctaccagatcacgaacaagttcgagtcgttcaagtccatgagcacgcagaacggctttatcttctacatcccggcctggctgacgtcgaagatcgacccctcgaccggcttcgtgaacctgctcaagaccaagtatactagcattgccgactccaagaaattcatctcgtccttcgaccgcatcatgtacgtcccggaggaggacctttttgagttcgccctcgactacaagaacttcagccgcaccgacgccgactacatcaagaagtggaagctgtactcgtacgggaaccgcatccgtatttttcgcaacccgaagaaaaataatgtcttcgactgggaggaggtgtgcctgaccagcgcctacaaggagctgttcaacaagtacggcatcaactaccaacagggcgacatccgggcccttctctgcgagcagagcgacaaggcgttctactcgtcgttcatggccctgatgagcctgatgctccagatgaggaacagcatcaccggccgcaccgacgtggacttcctcatcagccccgtcaagaactcggacggcatattttatgactcgcggaactacgaggcccaggagaacgccatcctgcccaagaacgccgacgccaacggcgcgtacaacatcgcccgcaaggtgctctgggccatcggccagttcaagaaggcggaagacgagaagctggacaaggtgaagatcgccatctccaacaaggagtggctggagtacgcgcagacgtccgtcaagcacggctccaagaaacggcggatcaaacaagattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgc

SEQ ID NO: 152 - DNA, 22 bp, Artificial Sequence
  Tobacco PDS PCR Primer Reverse
ttcaaaccgctcctaattgctg

SEQ ID NO: 153 - DNA, 22 bp, Artificial Sequence
  Tobacco PDS PCR Primer Forward
catagtccacaacgtgaaacac

SEQ ID NO: 154 - DNA, 20 bp, Artificial Sequence
  Yeast URA3 PCR Primer Reverse
ttagcatcccttccctttgc

SEQ ID NO: 155 - DNA, 22 bp, Artificial Sequence
  Yeast URA3 PCR Primer Forward
gcgaggcatatttatggtgaag

SEQ ID NO: 156 - DNA, 10901 bp, Nicotiana bethamiana
  misc_feature (3734)..(4041): n is a, c, g, or t
  misc_feature (5335)..(5335): n is a, c, g, or t
  misc_feature (6264)..(6264): n is a, c, g, or t
  misc_feature (6646)..(7576): n is a, c, g, or t
cattcatttacagatctacaaagattcttatcatatttgtttacgatttacccctatatattttcgattatttttaggcttataaaatacgaatataatttctgagttaaataatagaccttttttggtttccttactaaaacactcattcgacttttctttttcacccgagacaaaaagatattcactatatttaaaatgggtataattcataagaacaaaatataatctcgaaaagattaaattgcacgtgtacaaaatttataagatgttgaatggagtctcagtaagttaggtacacatttaggcatatacagaaaagattgatataaatttcctttttatattaaaaaaatgtaatttactatagaatacaaagaagaaacaattactactactaggaaccatcaacggataaggttatttctctcttaaccaaaagttttgtgttcgagtcgagtacttatgaaaaaatttgtccgagcggggttatgtgcggtacggatttcaatataatcgagttttaatacggatatcgaacactgaattaaaaactaaaaaagaattgtgaaaatagcatgggttagctagttttcggattggtaattaaaaaatagccagcatttataaagtcattgaaaaataataactattttgctacaaattcaaatataatgtaattggtgcacgaacttctagcatattatgatggaactccaacacacaaaaaatttcaaaataatatactgaaaattggagtacctatgtatgaactttcagaatattataccggatcaatatattatgctgaaatatttttcggactttaaataatttctttatttaaatttatttttatacaaaaataactaaatttcaattacttttaaaattatgattatttttcaattaccacttatacatcctgctattttgaatttcacccgaaagaactactactatacgtggatcctcaatgacccagtaacccaagtgggagatgtgtgcaaagtggtcaaatcttagaaggaatgagcaaagcaagaaattaaaaagagagacagagaggtgttatccatcaaatgtggctatggtcggaatagccaatggtgggacagtctagccaaacataaaggccggtccagtgcgagttgctgcaaattgagttggagtaaaaaattaagataccatatttccagctaaatagcaaacaaatgacccaccattaacggaagtggccaaaccaccaaattcaggcatctccaccaaaaattagttttttatacacgaaagattcaacaattagtatttctttaagccttcctaattctttgtcaggggtatctttttgtgggtaacagccaaaccaccacaaattttcagttcccactcttaactctttttaacttcaacacaacaaattttttgcttttccttctttgtttatcttgtgcataacgatttcctacaactttagcataatcttggtttgtaatccacaacgtgaaacacatcacctaggcggtttcataccgaggtaacaaatgattttggtttctttggttacatcagctgaatgctttacttgagaaaagctttctccttttcccgtttaggatcttgtttatttgctttcgtttttctactcgttaaaattttaacttgattttgtgggtgaattataactttactcatagtgcgagaacaagtttcgtatggactgtaaaagctagaatcttttttacttttgcatataaatttgtgtaataaatgcttaagaaccagaatattgaaaaaacaaaggaattctacatagtatttaggttcacaagtgggacaatcttcttacagtgaaatatctttatgtcaggcttaatttactgctattttgttcagtaaaatgccccaaattggacttgtttctgccgttaatttgagagtccaaggtaattcagcttatctttggagctcgaggtcttctttgggaactgaaagtcaagatggtcgcttgcaaaggaatttgttatgttttggtagtagcgactccatggggcataagtttagaattcgtactcccagtgccatgaccagaagattgacaaaggacttcaatcctttaaaggtttgttttgaatgcgaaagtgtgatgctgaatttatgatcacgagcatatattctctaaaataagatatcttgccattcaggtagtctgcattgattatccaagaccggagctagacaatacagttaactatttggaggcggcgttatcatcatcatcatttcgtacttcctcacgcccaacaaaaccattggagattgttattgctggtgcaggtgattttttccagtcatctatatttgtagtcttcatttttctttctttggaaggaagatcattctattagttgtattatcactagaacatttattgtgcattcttttcttattaactgttttggaccgcaaaattttaagttcttacttcttcgcctcccaactgattagattaggagtgatttgaaaattagtttgttttgagctatttttgccgtcactcatatactgttgagttgtcccacatcggtgagatttgaagtccttggtctcacctcataagttagcttttggggttgagttaggcccaatatccatttatcatagtacgagagccaggcccatcccagttattgttaccaatgtcgggctcctatttatgttgtccacgctccagtttgcaagcctaggcgtgggggaggggggtgttgagttgtcccacatccgtgggatttgaggtacttggtctccttatatggtcttggacaatccataagctagcttttggggttgagttcggcccaatgttcatttatcatatatatatatatatatatatatgtctattctctcttaccatctgagccatgataagcgggtgaacgtgctgtctattggatggcatgtccgatggatcattccgaaatattggaggcagatgaaccaataccttgtgcaagattgatatcactatacctataatcagagtacttagagttccaaaaatttgcagaacccattgaaaagtcaaacaagttacatataggggttgcactcttctaaggcttgcaatctgtgagaaaaagatgagaaggagatcttcatatttcatctttattaggctggaccattgaccggttagcagttttgaacttgttcttcaacttggcttgcatagtactgtgccgatcatttcttttgtattgtcatcaactggttgattatttgagtacctaaagaaagaatgttatgcatgatacattgtgctgtactataaaagatataataaagaatgctagccgaggtactacatggccttttcagacaaatagaagctgtagcatgattctaattcgatttgttttgaaatatcaggtttgggtggcttgtctacagcaaaatatctggcagatgctggtcacaaaccgatattgctggaggcaagagatgtcctaggtggaaaggtgaagaatatccaatctttcctttaattttattcctttttcttctgtgtccttgcctattggtagtccctgttcaggaaggcttctgtttgttttatttaaaatcatttttcatactctttaaacattcagttgctcaaacaattgcaagggtgttcactattcctatttttgactgtcttactttctctcagtttagttttattcccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccctgtctctctctctctctctgtttttggaggaaatagatctgtcctaaaaacttccagctttactactaatagtgttaattgtcgagaaaatattacagcatattaggtatatggaaagtatattattattctctattattttaagattgagtcaattttacccgtcctgttggttgcatttctcacataaacagtcttttctgtgagatgctatgttaattagctgatgtttttggtatagagcactatgttagttttatctttactgaagcagtcaccaagaatctagttgtataggctaaaagattgaattagcattaatctttatgtgttttgcacctgaatacctatacctaccttttaggtagctgcatggaaagatgatgatggagattggtacgagactgggttgcacatattctgtaagtttgactcctcaagaatgcatactttaatcttctaatacaacagtttctttcaagatctcttttctctattaatcagatagatatcgctgtttgtgttttgtcttttgcaaatagccaatttttgtcagtcgatctgtattctgccttgcctatctttttttatctgttaatttcatatggtgactcatacaagttggtgcatcccctttaagttggggcttacccaaatatgcagaacctgtttggagaactagggattaacgatcggttgcagtggaaggaacattcgatgatatttgcgatgcctaacaagccgggggagttcagccgctttgattttcctgaagctcttcctgcgccattaaatggttagtacttaatcatgatttctcccttctgcattgattatccaataaggtatgaaattgattagtccattgaccattaatactctggcacattgctaacatcaaaagaacataaaggttcattatgtcttgatcagaatttctgcatgtagctaaagtgattgagtgtctgtgtatatttttatacattgcaagcataagccagttatgttatctcttattttcatttctctatcgatgcgttattacttctacaggaattttagccatactaaagaacaacgaaatgcttacatggcccgaaaaaatcaaatttgctattggactcttgccagcaatgcttggagggcaatcttatgttgaagctcaagacggtttaagtgttaaggactggatgagaaagcaagtatgtgatcgttttatcttattctttaaagttcataaccttgaggacatagttgacttgcatgttgttgatttaacatgttnatgtgatcgttttatcttactctttaaagttcataaccttgaggacatagttgacttgcatgttgttgatttaacatgttagaattgtctacctgcctttctttttttaacaacatacatcttacaaatctcagcagcagctatttgcttaattgcttttcagggtgtgcctgatagggtgacagatgaggtgttcattgccatgtcaaaggcacttaacttcataaaccctgacgagctttcgatgcagtgcattttgattgctttgaacagatttcttcaggttagaatcctgatccaccctcaaaacaaaaagagagaaagggatataatccgaccaagctgtaaatcatgttagggacctgacatattggtgcaggaaacttatttgtgaacttttccactctgtttaacttttctgatatatttgaattattaatctgcaggagaaacatggttcaaaaatggcctttttagatggtaatcctcctgagagactttgcatgccaattgttgaacatattgagtcaaaaggtggccaagtcagactaaactcacgaataaaaaagattgagctgaatgaggatggaagtgtcaaatgttttatactgaataatggcagtacaattaaaggagatgcttttgtgtttgccactccaggtataatatccattatactagtatcgatgcttccagttttcacatttttaatatgaatgtataattttttgctgacttttcattatccgattagtggatatcttcaagcttcttttgcctgaagactggaaagagatcccatatttccaaaagttggagaagctagtgggagttcctgtgataaatgtccatatatggttagtgatgaaaattttgcttttcagtgtttggtcttcctctagcatatctatgtatgtgcatgttaatgnacttttcagtgtttgttcttcctctagcatatctatgtatgtgcctgttaatgtctatacatacatgtttatgtggtcctccggtattgtgttaacttcccttgagcgaggaacttatggatctacgcttttccaaaactttgattgcacacattgcaattgtctgttcaactttgatgagcagaactaccattgtttagctattagtggctgagattcctgctgaaaagatttgtataaatttaattgcaggtttgacagaaaactgaagaacacatctgataatctgctcttcagcaggttcatttttgatcaattttattgttccagagcagtttctgcgtgtccatgactacattctcatattagctccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatgttatgatgaccatttctccaaggcattttatccatgccacgtttcatcagctacatgttgactatgttcccctactttttaaatggcaccattgttggtggagaaagattatagatgttcctgatacttgtatgggttcccttgctcaatctctcttttacttcatgcagaagcccattgctcagtgtgtatgctgacatgtctgttacatgtaaggtattgactcgtctgtaccattcatactggtctaatctgttggatatgagttgctggtaaattgcataatgcttgttggatttgtgtgtgagttgctgctagatctgtgtcctgctatatttatgtatgagttgctgctattgtaatcttcatttaggatgcttaatgatataggttctgtatgtatggaatagtcaggacaatgctcctgtctgtgcacaggggctctacaggaagcaactttcgaaggagaagtaaagaaagtgtgatgaacagggaaagtagtttcctttagctaccttaattcagtgttacctgcaatgttcagtgtttggagagaggcgataagcctacttcttaattttgttagaaaatgcgtacaaaatataaatcagtagttactaaaaagttggagaagtagtgggatcttttcgctatttttaacccagaataagacagctatgccatatagctttgattatccgttaacgttctgtatataaatagataattcataataatgtcgtaatactaaagcctggagatcagactgctttaactatcctgagatgattacttttactcttggattagcttaggcgagccacaagactacattgaatctttagaaatgagaacataaaaagggtgcagaagtggggaagtggctgaacgatatgcatatgggagtgagtggggagtaaaattatttcctttacttgggtacaatcaagaatgaatgacaacttagcccactatatccgttcatgtgttctttagggccctctgatataattggtctctctgcaggaatattacaaccccaatcagtctatgttggaattggtatttgcacctgcagaagagtggataaatcgtagtgactcagaaattattgatgctacaatgaaggaactagcaaagcttttccctgacgaaatttcggcagatcagagcaaagcaaaaatattgaagtatcatgttgtcaaaactccaaggccagtaatcatttgctttcatacttgtgcaatatacgagaactgcagtccacgtggaatctattcctattctgaatcctgattaatctgctttttttctctcaggtctgtttataaaactgtgccaggttgtgaaccctgtcggcccttgcaaagatctcctattgaggggttttatttagctggcgactacacaaaacagaaatacttggcttcaatggaaggtgctgtcttatcaggaaagctttgtgcccaagctattgtacaggttagttctcacagttgtttttgtccactaatagtatatttgatcaaattttgtcatctttgctgcggtagagaatttttgaagcatggacgtcaagcatgcctcttacttataattgctaatttgcggaatagttctccaaccaatatagtgttaaaccaaaaaaataaaattgtgcacacagatcacagagttgctcaggatatctgcatttttggagcctcagtagtagcatgataaaatgcagaaggttatgtttttttcattctttattaaatttatatctctatattttgcaggattacgagttacttcttggccggagccagaagaagttggcagaagcaagcgtagtttagcatggtgaactaaaatgttgcttctctacactaaatttaagatgaaggtggccacactgaattagcgttgtagacaacacatacaaggacagtacaacatttaacccaaatacgagaaatgttacacaaatatgtgctctgctttccctccgatttagttcgcaagttactaattataagatggaattgaatgaaaccaaagacggataaagaccctaaactataagataagtaagcctctccagaccatacaagtgcgcgtcgagcccatgcgaagggtttggttaagatatgccagattccaccaagtatacaaatgaaacctaaccatacatgtcctccgattatataatgcaaattgattcattcaaactaaacttttaagcgtcacagttatactagcaaatacctttaagacattaagcttcacgtcttaaaacatcaaaaaccgcttttagagtaagtatccaactgaaccatgcaaaacacaaaactgaaacaaagaacaaatggaactactaaaagagacaattaaaaattttaatttggtaaactgttaaaacgtgtttgcaagtatgagatttttttctacaaccccaagaaaactctgtcgctacagcctttgccttttgagcgagcactctgtacccattgggtaaacttcttaccgtgtaatagcttgcaaaccacacatgaatataaaccgcactaggcaagcaatgtgcgacagactcaacccagaaagcattgaagggggattaatcccaaatcatctgtatggatgaccgctcttcaaaccaaatggccatcccaaagggattgaaagtatcggatagtaatgaaccaatcagaaccacacaaaaaagaagataaatgctgaatttggagcgatggctgaatgcattgggattactttaaaaaatatttggattttctgtgtacaacttaatatttaagcaaactagatcatataatatgtactactactatgtatcattagtcaacagctgctcacttacagaaataggatcaggtagcttttgttatactctattgcacatacactgtattcagataagaaatgcaaatagatgtacgaaacaatctacgcaaaaggaatgttcttagaaaaaagaaaggctctccccaatacttatcgtatcttccctctgttggttcactgaatgtgtactgtggttttactataccctttttcctattgcagcatcattttcttctcgaaaaattcctccaatttctagggaattgctacttttcccctaccaataatttatgtacatcgtcaaggctcaaagagcaagagattatgcatatctacatagcttctcatatgtccaatacatttgtatttctgcttcttagtcctacttggcagccctgagcacgaaagcatttcgcatgcaagcagggtggggagaaaagctgcactcaagaaggtttgatgtaggtaacttattg

SEQ ID NO: 157 - DNA, 2804 bp, Saccharomyces cerevisiae
tcataaaattgataaggagaatccatacaagaaatcgatcgaattatcattgaaatccattcaactaacatcacacttgctggaagataataacgatctgcgtaaaaacgagatattcgctattattcaagctttggcacatcaatgcatcaatccgtgtaagcagataagtgaatttgcagtggtaacgctagagcagacgctcatcaataaaatcgaaattccaactaatgagatggaatcggtagaagaattaattgagggcggattactaccgttgctaaattcgagtgaaacacaggaagaccagaaaatcctcatttcatccatattaacaataatttcaaatgtttatttgcattatttgaaactagggaagacaagcaacgaaacgtttttgaaaattttgagtattttcaataaatttgtagaggactcagatattgaaaaaaagctacagcaattaatacttgataagaagagtattgagaagggcaacggttcatcatctcatggatctgcacatgaacaaacaccagagtcaaacgacgttgaaattgaggctactgcgccaattgatgacaatacagacgatgataacaaaccgaagttatctgatgtagaaaaggattaaagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcggaagaagtaacaaaggaacctagaggccttttgatgttagcagaattgtcatgcaagggctccctagctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttctataatgacgaaaaaaaaaaaattggaaagaaaaagcttcatggcctttataaaaaggaactatccaatacctcgccagaaccaagtaacagtattttacggggcacaaatcaagaacaataagacaggactgtaaagatggacgcattgaactccaaagaacaacaagagttccaaaaagtagtggaacaaaagcaaatgaaggatttcatgcgtttgtactctaatctggtagaaagatgtttcacagactgtgtcaatgacttcacaacatcaaagctaaccaataaggaacaaacatgcatcatgaagtgctcagaaaagttcttgaagcatagcgaacgtgtagggcagcgtttccaagaacaaaacgctgccttgggacaaggcttgggccgataaggtgtactggcgtatatatatctaattatgtatctctggtgtagcccatttttagcatgtaaatataaagagaaaccatatctaatctaaccaaatccaaacaaaattcaatagttactatcgcttttttctttctgtatcgcaaataagtgaaaattaaaaaagaaagattaaattggaagttggatatgggctggaacagcagcagtaatcggtatcgggttcgccactaatgacgtcctacgattgcactcaacagaccttgacgctcacgccgtagcgggcgacaagtcaaacggaacaaccgttgccgttcccatcggagtccgacctaggccgaactccgtgaatttctgataacaacggtcggtaaagactggttccccagtatatttcttctctcaggagcaggggccaatgccaaaagcgacattaacccggaggacaaggctccactgtgttccaccgaatttcccacctgataatatctgataac

SEQ ID NO: 158 - DNA, 7411 bp, Artificial Sequence
  pWISE3116 Full Plasmid Sequence
cccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggatcaaaaaaaagaaggatcaagcaagatccgccgccagcgctgccgcccaagcgccgtcgctccggcggtagcagcggtggttccccgccgccggctctgccgccgaagcgccgtagaagcggcggttcaagcggtggctctccgccaccggcactgcctccgaaacgtcgtcgttctggcggtagcagcggtggctcgccgccgccggcgttgccgccgaaacgccgtcgttccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcg

SEQ ID NO: 159 - DNA, 19324 bp, Artificial Sequence
  pWISE3098 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcgtccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcacggctcctccgagacaccaggcacctccgagagcgcgacgcccgagggcggctccggcggctccggcagcgaggaactgctgtccaagaactatcacctggagaacgaggttgcaagactgaagaagggatctggctcaggaggctctggcagcggtgggtccggttcagggtctggaggcagcggttccggtgggtcaggatctggtgaggaactgctgtctaagaactaccatctggagaacgaggttgctaggctgaagaagggtagcgggtccggaggctcaggatctggtgggagcggatctggctcaggaggctctggcagcggtgggtccggttcaggtgaagagttgctgagcaagaactaccacctggagaacgaggtagccagactgaagaagggatctggcagcggaggctccggatcaggtgggtctggtagcgggtccggaggctcaggctctggtgggagcggatctggtgaagagttgttgtccaagaactaccatctggagaacgaggtagcaaggctgaagaagggttcagggtctggaggcagcggatctggaggatctggatctggcagcggaggctccggctcaggtgggtctggtagcggcgaagagttgttgtctaagaactaccacctggagaacgaggtcgcgagactgaagaagggatctggctcaggaggctctggaagcggtgggtccggttcagggtctggaggcagcggctccggtgggtcaggatctggagaagagcttttgagcaagaactaccatctggagaacgaggtcgccaggctgaagaagggtagcgggtccggaggctcaggatctggtgggagcggatctggctcaggaggctctggcagcggtgggtccggttcaggcgaagagttgctttctaagaactaccacctggagaacgaggtagcgagactgaagaagggatctggcagcggaggctccggatcaggtgggtctggtagcgggtccggaggctcaggctctggtgggagcggatctggagaagagctgctgtctaagaactatcatctggagaatgaggttgcaaggctgaagaagtgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 160 - DNA, 19324 bp, Artificial Sequence
  pWISE3093 Full Plasmid Sequence
agcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgggggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataaggatcaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgccactgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagggtatggcggaggaactgctgtccaagaactatcacctggagaacgaggttgcaagactgaagaagggatctggctcaggaggctctggcagcggtgggtccggttcagggtctggaggcagcggttccggtgggtcaggatctggtgaggaactgctgtctaagaactaccatctggagaacgaggttgctaggctgaagaagggtagcgggtccggaggctcaggatctggtgggagcggatctggctcaggaggctctggcagcggtgggtccggttcaggtgaagagttgctgagcaagaactaccacctggagaacgaggtagccagactgaagaagggatctggcagcggaggctccggatcaggtgggtctggtagcgggtccggaggctcaggctctggtgggagcggatctggtgaagagttgttgtccaagaactaccatctggagaacgaggtagcaaggctgaagaagggttcagggtctggaggcagcggatctggaggatctggatctggcagcggaggctccggctcaggtgggtctggtagcggcgaagagttgttgtctaagaactaccacctggagaacgaggtcgcgagactgaagaagggatctggctcaggaggctctggaagcggtgggtccggttcagggtctggaggcagcggctccggtgggtcaggatctggagaagagcttttgagcaagaactaccatctggagaacgaggtcgccaggctgaagaagggtagcgggtccggaggctcaggatctggtgggagcggatctggctcaggaggctctggcagcggtgggtccggttcaggcgaagagttgctttctaagaactaccacctggagaacgaggtagcgagactgaagaagggatctggcagcggaggctccggatcaggtgggtctggtagcgggtccggaggctcaggctctggtgggagcggatctggagaagagctgctgtctaagaactatcatctggagaatgaggttgcaaggctgaagaagggctcctccgagacaccaggcacctccgagagcgcgacgcccgagggcggctccggcggctccggcagctccaagctggagaagtttacaaactgttacagcctctccaaaaccctcaggtttaaagcgatcccggtgggcaagacccaggagaacatcgacaacaagaggctcctggtggaagacgagaagcgcgccgaagactacaagggcgtgaagaagctgctcgataggtactacctcagctttattaacgacgtgctgcacagcatcaaactcaagaatctcaacaactacatctccctcttccgcaaaaagacccgcaccgagaaggagaacaaggagctggagaacctggagatcaacctccgcaaggaaatcgccaaagcgttcaagggcaatgaagggtacaagagcctcttcaagaaagacatcatcgaaactatcctcccagagtttctcgatgacaaggacgagatcgcgctggtgaactcctttaacgggttcacaaccgcgtttaccggcttctttgataacagggaaaatatgttctccgaggaggccaagtccaccagcatcgccttcaggtgtatcaacgagaacctcacccgctacatttccaatatggacattttcgagaaggtggatgcgatcttcgataagcacgaggtgcaggagatcaaagagaagattctcaattccgattatgacgtcgaggatttcttcgaaggggagttctttaattttgtgctcacacaagagggcattgacgtgtacaacgcgattatcgggggcttcgtcacagagtccggggagaagattaaggggctgaatgagtacatcaatctgtacaatcagaagaccaagcagaaactgccgaaattcaagccgctctacaagcaagtcctgtccgatagggaaagcctctccttctacggcgagggctataccagcgacgaggaggtgctggaagtcttccgcaacacactgaataagaatagcgagattttctcctccatcaagaagctcgagaagctctttaagaactttgacgagtacagctccgccgggattttcgtgaagaacgggccggcgatcagcaccatctccaaggacatctttggcgagtggaacgtcatcagggacaagtggaacgccgagtacgacgacatccacctgaagaagaaggcggtggtgaccgagaagtatgaggacgatcgcaggaagtccttcaaaaaaatcggctccttcagcctcgaacagctccaggagtatgccgatgcggatctgtccgtcgtcgagaagctgaaggaaatcatcattcagaaggtcgacgagatctataaagtgtacgggtccagcgagaagctgttcgacgccgactttgtgctcgagaagtccctcaaaaagaatgacgccgtggtggccattatgaaagacctgctcgactccgtgaagtccttcgaaaattacattaaagcgttctttggggaggggaaggaaactaacagggatgagtccttctatggcgactttgtcctcgcgtacgacatcctgctgaaggtcgaccacatttacgacgcgatccgcaactacgtgacacagaagccgtactccaaagacaagttcaagctgtacttccagaacccgcaatttatggggggctgggacaaggataaagagacagactaccgcgcgacaattctccgctatggctccaaatactatctggccatcatggacaagaagtacgcgaagtgcctgcagaagatcgacaaagacgacgtcaatggcaactatgaaaagatcaactacaagctgctgccgggtccgaacaagatgctcccgaaggtgttcttcagcaagaagtggatggcctactacaatccaagcgaggatattcagaaaatctataaaaacgggaccttcaagaagggggacatgtttaacctcaacgactgccacaagctcattgatttcttcaaggatagcatttcccgctacccgaaatggtccaatgcgtacgattttaacttctccgagacagaaaagtacaaagacatcgcgggcttttacagggaggtggaggagcaagggtataaagtttcttttgaatccgcgagcaagaaggaagtcgacaagctcgtcgaggagggcaagctctacatgttccaaatttataacaaggacttttccgacaagagccatgggaccccaaacctccacaccatgtacttcaaactgctctttgacgagaacaaccacgggcaaatcaggctgagcggcggcgccgaattattcatgcgcagggcctccctcaagaaggaagagctggtcgtccatccagccaattccccgatcgcgaacaagaacccggacaatccgaaaaagaccaccaccctgtcctacgacgtctacaaggacaaacgcttcagcgaagaccagtacgaattacacatcccaattgcgattaataagtgcccaaagaatatcttcaaaattaatacagaggtcagggtgctgctcaaacacgacgacaatccgtatgtcatcggcattgacaggggcgagcgcaatctgctctatatcgtggtcgtggatgggaagggcaatattgtggagcagtactccctgaacgagattatcaacaacttcaatgggattaggattaagaccgactatcacagcctgctcgacaagaaagaaaaagagaggtttgaggcccgccaaaactggacctccattgagaatatcaaagaattaaaggccggctatatttcccaagtcgtccacaagatctgcgagctggtggagaaatatgacgccgtgattgcgctcgaagacttaaattctgggttcaagaactcccgcgtgaaggtggaaaaacaggtgtatcagaaattcgagaaaatgctgatcgacaaactcaattatatggtggataagaagtccaacccgtgtgccacagggggcgcgctgaagggctatcagatcaccaacaagttcgagagcttcaagagcatgagcacccagaacgggtttattttctacatcccggcgtggctcacctccaagattgacccgagcaccggcttcgtgaacctcctgaagacaaagtatacctccattgccgacagcaagaagtttatctcctccttcgaccgcattatgtatgtgccggaggaggacctcttcgagttcgccctcgactacaaaaacttcagccgcacagatgcggattacatcaagaagtggaagctgtactcctacgggaacaggatccgcatcttcaggaatccaaaaaaaaataacgtctttgactgggaggaagtgtgcctgacatccgcctacaaggaactgttcaataaatacggcatcaattaccagcagggcgacattcgcgccctcctctgtgagcagtccgacaaagcgttttactccagcttcatggccctcatgtccctgatgctccaaatgaggaatagcatcacagggcgcaccgacgtcgacttcctcatcagcccggtgaagaactccgacgggatcttttacgactcccgcaactatgaggcgcaagagaatgcgatcctcccgaagaacgccgatgcgaacggggcctataatatcgccaggaaagtgctctgggccatcgggcagttcaaaaaggcggaggatgagaagctcgacaaggtgaaaattgccatttccaacaaggagtggctggagtacgcgcagacctccgtgaagcactgaaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctccctgcaggatcccaatggcgcgcctagctaactagctagccacgtgactcgcagaacgttgtgtggcgagacggaaagaaagtcacgcctccaaagagtgcagcatctcttctggctctcacggtcctctgtggatccatcgatatcgaattcctgcaggctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggcggccgcatggcccagtctaagcacgggttgacgaaggagatgactatgaagtatcgcatggaaggctgcgttgacggccacaaattcgtcattaccggcgagggcatcggctacccctttaaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcagggcaagcaagcgataaacctgtgcgtggtggagggtggccctctgcccttcgccgaggatatactctcagccgccttcatgtacgggaatcgggtgttcacggagtacccgcaagacatcgtggactacttcaagaactcctgccccgccggatacacatgggaccgttccttcctcttcgaggacggagccgtttgcatctgcaacgcggacatcaccgtgtccgtcgaggagaactgcatgtaccacgagtcaaagttctatggagtgaacttcccggccgatggtcccgtgatgaagaaaatgacggacaactgggagccgtcgtgcgagaaaatcattcccgtcccaaaacagggaatcctcaagggcgacgtgtcgatgtacctacttctcaaggacggtggacggctacggtgccagttcgacactgtttacaaggcgaagtcggtgccgaggaagatgccggactggcactttatccagcacaagctgacaagggaggacagaagcgacgctaagaaccagaaatggcacctcaccgagcacgccatcgccagtggctctgcgctgcccgggtgaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgagggcccggccgtgacggccacgagcgaactcctgcaggcgataaaaatgttttaaacgatatatattataaaaaaaaacgtttcaaaaataaatacaaaaatgtttttaaatatatataatttaactcattaaagaaaataaaaatgcaagtgcggtgacaagacaagctaaaagttgcaaaagaaatggcagggctataaggctcacctactcctggatttaccaaattttggttcgtccctatactcgaaaaataaaacaaaataaatttcagtatcttcgtttttgtatgctttgactgtgaggcgaggccaactttcttcttctgtctgagatgaattttgtttgcctcctgtgaaggatgtatcattcaaagtgaatgttttgcaactgccagtagtcccacatcgaccaaatattcttattacagtgtgtttatatagcacctggagaaggaatgggttgtttcaaagattaaataatttctactaagtgtagattgccgttaatttgagagtccaagtaatttctactaagtgtagatttttttttgcggccgcacaacaaacgcgccggcga

SEQ ID NO: 161 - DNA, 7858 bp, Artificial Sequence
  pWISE3121 Full Plasmid Sequence
cggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtgggggctcctcgggtggcagcatgagcggatcaaagaaacgtaggatcaagcaagatggtccggatattgttatgacccagagcccgagcagcctgagtgctagcgttggtgaccgtgttaccattacgtgccgtagctcgaccggtgcggtgaccacttctaactatgccagctgggttcaggagaaaccgggtaaacttttcaaaggtcttatcggcggtacgaacaaccgtgcgcctggtgtgccaagccgtttctccggttctctgatcggcgacaaagctactctgaccatctcttccctgcagccggaagattttgcgacctacttctgcgcgctgtggtatagcaatcactgggtgtttggccaaggtacgaaagtggagctgaagcgcggtggtggcggctccggcggaggcggctccggtggcggcggaagctccggcggcggcagcgaagttaaactgctggagtcggggggcggtctggttcaaccgggtggttctctcaagttgtcttgtgctgtgagcggttttagcttgaccgactacggcgtgaattgggtgcgtcaggcaccgggccgtggtctggaatggattggcgtcatctggggcgatggtattacggactacaacagcgcgctgaaggaccgcttcatcatcagcaaggacaatggtaagaacaccgtctatctgcaaatgagcaaggtgagatccgatgacaccgcattgtactactgcgtcaccggtttgtttgattactggggtcagggcaccttggttaccgtgagctcctatccgtatgacgttccggattacgccggtagcaagaaacgccgtattaaacaagattccggtagtggggggtcctctggtggaagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcccac

SEQ ID NO: 162 - DNA, 8116 bp, Artificial Sequence
  pWISE3117 Full Plasmid Sequence
caccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtgggggctcctcgggtggcagcatgagcggatcaaagaaaagaaggatcaagcaagatgaggaattgctgagtaaaaactaccatcttgagaacgaagttgcccgtctgaagaagggtagcggttcgggcggtagcggttccggaggtagcggcagcggctcgggtggtagcggttcaggtggctcaggcagtggtgaagaattgctgagcaaaaattatcacctggagaatgaagttgcgcgtctgaagaaaggcagcggctccggtggttctggctcgggcggttcaggtagtggttccggtggctccggcagcggtggttctggctccggtgaagagttgttgtccaagaattatcatctggaaaacgaagtggcaagactcaagaagggttcgggttcgggcggcagcggaagtggtggtagcggaagcggcagcggcggctccggctccggtggctccggcagcggtgaggagctgctgagcaagaactaccacttggagaacgaagtggcacgcctgaagaaaggtagcggtagcggcggttctgggagcggtggctccggaagcggcagcggcggttcgggttctggtggcagcggtagcggcgaagagctgcttagcaaaaattatcaccttgagaacgaggtcgctcgcctgaaaaaaggttccggcagcggcggtagcggtagcggtggcagcggtagcggcagcggtggctcggggtccggtggtagcggctccggtgaagaattgttgtccaaaaactaccacctggagaatgaagtggcgcgtctgaaaaagggtagcggcagcggtggtagcggctctggaggtagcggctccggtagtggcggtagcgggtctggcggctctggttcaggcgaagaactgctcagcaagaattaccatttggagaacgaggttgcgcgcctgaaaaagggctctggtagcggcggttctggctctggtggcagcgggagcggctccggtggcagcggctctggaggttccggttcgggtgaggagctgctgagcaagaactaccacctggaaaacgaggtggcgcgtctgaaaaaaggcagcaagaaacgtcgtatcaaacaggactccggtagtggggggtcctctggtggaagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgccccgcgcc

SEQ ID NO: 163 - DNA, 7900 bp, Artificial Sequence
  pWISE3107 Full Plasmid Sequence
gtcatgccccgcgcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgagcggatcaaagaaacgtaggatcaagcaagatggtccggatattgttatgacccagagcccgagcagcctgagtgctagcgttggtgaccgtgttaccattacgtgccgtagctcgaccggtgcggtgaccacttctaactatgccagctgggttcaggagaaaccgggtaaacttttcaaaggtcttatcggcggtacgaacaaccgtgcgcctggtgtgccaagccgtttctccggttctctgatcggcgacaaagctactctgaccatctcttccctgcagccggaagattttgcgacctacttctgcgcgctgtggtatagcaatcactgggtgtttggccaaggtacgaaagtggagctgaagcgcggtggtggcggctccggcggaggcggctccggtggcggcggaagctccggcggcggcagcgaagttaaactgctggagtcggggggcggtctggttcaaccgggtggttctctcaagttgtcttgtgctgtgagcggttttagcttgaccgactacggcgtgaattgggtgcgtcaggcaccgggccgtggtctggaatggattggcgtcatctggggcgatggtattacggactacaacagcgcgctgaaggaccgcttcatcatcagcaaggacaatggtaagaacaccgtctatctgcaaatgagcaaggtgagatccgatgacaccgcattgtactactgcgtcaccggtttgtttgattactggggtcagggcaccttggttaccgtgagctcctatccgtatgacgttccggattacgccggtagcaagaaacgccgtattaaacaagattccggtggaagttccggaggttcaagcgggtctgaaacgccgggcaccagcgagtcggcgaccccggaaagcagcggtggttcttccggcggtagcatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagatagtctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgcta

SEQ ID NO: 164 - DNA, 8002 bp, Artificial Sequence
  pWISE3114 Full Plasmid Sequence
ccgcgcccaccggaaggagctgactgggttgaaggctctcaagggcatcggtcgagatcccggtgcctaatgagtgagctaacttacattaattgcgttgcgccccgggatgagattatcaaaaaggatcttcacctagatccttttaaattaaaaatgaagttttaaatcaatctaaagtatatatgtgtaacattggtctagtgattggatccttgacagctagctcagtcctaggtactgtgctagcgctagcaaagaggagaaaggtaccatgcccgatcgagctcaagttatcattcgcattgtgccgggaggtggcaccaagacccttcaacaaattatcaatcagttggagtatctatcccggaagggcaggctggagctgcagcgttcagcccgacatctcgatattcccctgccaccggatcaaatccacgaacttgcccgaagctgggttcaagagactggaacttatgacgaaagtcagccagacgaggaaaggcaacaggagttgaccacccatattattgtaagcttccccgccggtacaagccaggtagcggcttatgcggcgagccgggagtgggcagccgagatgtttgggtcaggcgcaggggggggccgatacaactatcttacggccttccacatcgatcgcgaccacccacatctgcatgtcgtcgtcaatcggcgcgaacttttaggacacggctggctgaagatatctcggcgccatccccaactgaattacgacgccctgcgcataaagatggccgagatttcacttcgtcatggcattgccctcgatgcgagccgacgagcagaacgtggcatcaccgagcggccgatcacttatgcccaatatcggcgccttgagcgggagcaggctcgccaaatccgtttcgaagacgcggatttggaacagtcgtcgccgcaaggagatcatccagaattcagccaacctttcgatacatccccatttgaagcatccgcgggcggaccggaggacatgcctcggcccaacaatcggcagaatgagtcgcaagttcatctccaggagccagctggtgtcagcaacgaagccggtgtccttgtgcgggttgcattggaaacggagcgccttgctcaaccattcgtttccgaaaccattctcgcggacgacatagggagcggctcttcgcgtgttgccgagggccgtgtggagagcgcaaaccgcactcccgatattcctcgcgcagcaactgaagctgccacgcacacgacacacgaccggcagcggcgtgcaaagcgtcctcatgatgacgacggagggccgagtggagcaaaacgtgtgacattggaaggcatcgcggttgggccccaggcgaacgccggcgaacaggatggcagtagtggccccttagtacggcaagctggaacgtcacggccatctccaccgacggccacgacgcgggccagcaccgcaaccgattcattgtctgctacagcccacctccagcaacggagaggtgtcctttcaaagcgtccgcgtgaagatgatgatggagaaccgagtgaacgcaaacgcgagagagatgagcgcagcaaggacgggcgtgggggaaataggagaagcggtggctcctcgggtggcagcatgagcggatcaaagaaacgtaggatcaagcaagatggtccggatattgttatgacccagagcccgagcagcctgagtgctagcgttggtgaccgtgttaccattacgtgccgtagctcgaccggtgcggtgaccacttctaactatgccagctgggttcaggagaaaccgggtaaacttttcaaaggtcttatcggcggtacgaacaaccgtgcgcctggtgtgccaagccgtttctccggttctctgatcggcgacaaagctactctgaccatctcttccctgcagccggaagattttgcgacctacttctgcgcgctgtggtatagcaatcactgggtgtttggccaaggtacgaaagtggagctgaagcgcggtggtggcggctccggcggaggcggctccggtggcggcggaagctccggcggcggcagcgaagttaaactgctggagtcggggggcggtctggttcaaccgggtggttctctcaagttgtcttgtgctgtgagcggttttagcttgaccgactacggcgtgaattgggtgcgtcaggcaccgggccgtggtctggaatggattggcgtcatctggggcgatggtattacggactacaacagcgcgctgaaggaccgcttcatcatcagcaaggacaatggtaagaacaccgtctatctgcaaatgagcaaggtgagatccgatgacaccgcattgtactactgcgtcaccggtttgtttgattactggggtcagggcaccttggttaccgtgagctcctatccgtatgacgttccggattacgccggtagcaagaaacgccgtattaaacaagattccggtggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataatctagaccaggcatcaaataaaacgaaaggctcagtcgaaagactgggcctttcgttttatctgttgtttgtcggtgaacgctctctactagagtcacactggctcaccttcgggtgggcctttctgcgtttatagtacgatatcccaatggcgcgccgagcttggctcgagcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctgttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaaacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccagggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggcccttttgtctcgcgcgtttcggtgatgacggtgaaaacctctgacacatgcagctcccggagactgtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgttgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgagcggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcatatgctagtcatgcc

SEQ ID NO: 165 - DNA, 171 bp, Agrobacterium tumefaciens strain C58
ggcagttccggtggcagcagtgcgtcgttagcaagaggcggtccaaatgcagtgggactcctaacgacgaacgaaagctttgagaaaaatatcaatgaggtctacaaccgtacgcgagccgagctagacgcttcttcacgtgacagaagtcgctctggactatcgcgataa

SEQ ID NO: 166 - protein, 74 aa, Agrobacterium tumefaciens
SGPLVRQAGTSRPSPPTATTRASTATDSLSATAHLQQRRGVLSKRPREDDDGEPSERKRERDERSKDGRGGNRR

SEQ ID NO: 167 - protein, 50 aa, Agrobacterium tumefaciens strain C58
SASLARGGPNAVGLLTTNESFEKNINEVYNRTRAELDASSRDRSRSGLSR

SEQ ID NO: 168 - protein, 373 aa, Agrobacterium tumefaciens
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGS

SEQ ID NO: 169 - protein, 275 aa, Saccharomyces cerevisiae
GSKKRRIKQDGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGSKKRRIKQD

SEQ ID NO: 170 - protein, 742 aa, Artificial sequence
  Synthetic VirD2::scFV fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGGSSGGSMSGSKKRRIKQDGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGSKKRRIKQDSGSGGSSGGSSGPLVRQAGTSRPSPPTATTRASTATDSLSATAHLQQRRGVLSKRPREDDDGEPSERKRERDERSKDGRGGNRR

SEQ ID NO: 171 - protein, 1228 aa, Artificial sequence
  Lachnospiraceae bacterium ND2006
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 172 - protein, 19 aa, Saccharomyces cerevisiae
EELLSKNYHLENEVARLKK

SEQ ID NO: 173 - protein, 1593 aa, Artificial sequence
  Synthetic 8xGCN4::Cas12a fusion
MAEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSSETPGTSESATPEGGSGGSGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 174 - protein, 1507 aa, Artificial sequence
  Synthetic scFV::Cas12a fusion
MAGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGSSETPGTSESATPEGGSGGSGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 175 - protein, 828 aa, Artificial sequence
  Synthetic VirD2::8xGCN4 fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGGSSGGSMSGSKKRRIKQDEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSKKRRIKQDSGSGGSSGGSSGPLVRQAGTSRPSPPTATTRASTATDSLSATAHLQQRRGVLSKRPREDDDGEPSERKRERDERSKDGRGGNRR

SEQ ID NO: 176 - protein, 1593 aa, Artificial sequence
  Synthetic Cas12a::8xGCN4 fusion
MASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSSETPGTSESATPEGGSGGSGSEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKK

SEQ ID NO: 177 - protein, 756 aa, Artificial sequence
  Synthetic scFv::VirD2 fusion
MSGSKKRRIKQDGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGSKKRRIKQDSGGSSGGSSGSETPGTSESATPESSGGSSGGSMPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRR

SEQ ID NO: 178 - protein, 842 aa, Artificial sequence
  Synthetic 8xGCN4::VirD2 fusion
MSGSKKRRIKQDEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSKKRRIKQDSGGSSGGSSGSETPGTSESATPESSGGSSGGSMPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRR

SEQ ID NO: 179 - protein, 1507 aa, Artificial sequence
  Synthetic Cas12a::scFV fusion
MASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSSETPGTSESATPEGGSGGSGSGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYA

SEQ ID NO: 180 - protein, 790 aa, Artificial sequence
  Synthetic VirD2-ScFv-VirF fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRRSGGSSGGSMSGSKKRRIKQDGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGSKKRRIKQDSGGSSGGSSASLARGGPNAVGLLTTNESFEKNINEVYNRTRAELDASSRDRSRSGLSR

SEQ ID NO: 181 - protein, 876 aa, Artificial sequence
  Synthetic VirD2::8xGCN4::VirF  fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRRSGGSSGGSMSGSKKRRIKQDEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSGSGGSGSGGSGSGSGGSGSGGSGSGEELLSKNYHLENEVARLKKGSKKRRIKQDSGGSSGGSSASLARGGPNAVGLLTTNESFEKNINEVYNRTRAELDASSRDRSRSGLSR

SEQ ID NO: 182 - protein, 548 aa, Artificial sequence; identical to SEQ ID NO: 99
  Synthetic SH3dom::VirD2 fusion

SEQ ID NO: 183 - protein, 1320 aa, Artificial sequence
  Synthetic Cas12a::4xSH3lig fusion
MASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSSETPGTSESATPEGGSGGSGSPPPALPPKRRRSGGSSGGSPPPALPPKRRRSGGSSGGSPPPALPPKRRRSGGSSGGSPPPALPPKRRR

SEQ ID NO: 184 - protein, 559 aa, Artificial sequence
  Synthetic 4xSH3lig::VirD2 fusion
MSGSKKRRIKQDPPPALPPKRRRSGGSSGGSPPPALPPKRRRSGGSSGGSPPPALPPKRRRSGGSSGGSPPPALPPKRRRSGGSSGGSSGSETPGTSESATPESSGGSSGGSMPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRR

SEQ ID NO: 185 - protein, 1309 aa, Artificial sequence
  Synthetic Cas12a::SH3dom fusion
MASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSSETPGTSESATPEGGSGGSGSAEYVRALFDFNGNDEEDLPFKKGDILRIRDKPEEQWWNAEDSEGKRGMIPVPYVEKY

SEQ ID NO: 186 - protein, 534 aa, Artificial sequence
  Synthetic VirD2::SH3dom fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGGSSGGSMSGSKKRRIKQDAEYVRALFDFNGNDEEDLPFKKGDILRIRDKPEEQWWNAEDSEGKRGMIPVPYVEKYSGSGGSSGGSSGPLVRQAGTSRPSPPTATTRASTATDSLSATAHLQQRRGVLSKRPREDDDGEPSERKRERDERSKDGRGGNRR

SEQ ID NO: 187 - protein, 1320 aa, Artificial sequence
  Synthetic 4xSH3lig::Cas12a fusion
MAPPPALPPKRRRSGGSSGGSPPPALPPKRRRSGGSSGGSPPPALPPKRRRSGGSSGGSPPPALPPKRRRGSSETPGTSESATPEGGSGGSGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 188 - protein, 545 aa, Artificial sequence
  Synthetic VirD2::SH3lig fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGGSSGGSMSGSKKRRIKQDPPPALPPKRRRSGGSSGGSPPPALPPKRRRSGGSSGGSPPPALPPKRRRSGGSSGGSPPPALPPKRRRSGSGGSSGGSSGPLVRQAGTSRPSPPTATTRASTATDSLSATAHLQQRRGVLSKRPREDDDGEPSERKRERDERSKDGRGGNRR

SEQ ID NO: 189 - protein, 1309 aa, Artificial sequence
  Synthetic SH3dom::Cas12a fusion
MAAEYVRALFDFNGNDEEDLPFKKGDILRIRDKPEEQWWNAEDSEGKRGMIPVPYVEKYGSSETPGTSESATPEGGSGGSGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 190 - protein, 582 aa, Artificial sequence
  Synthetic VirD2::SH3dom::VirF fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRRSGGSSGGSMSGSKKRRIKQDAEYVRALFDFNGNDEEDLPFKKGDILRIRDKPEEQWWNAEDSEGKRGMIPVPYVEKYSGGSSGGSSASLARGGPNAVGLLTTNESFEKNINEVYNRTRAELDASSRDRSRSGLSR

SEQ ID NO: 191 - protein, 593 aa, Artificial sequence
  Synthetic VirD2::4xSH3lig::VirF fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRRSGGSSGGSMSGSKKRRIKQDPPPALPPKRRRSGGSSGGSPPPALPPKRRRSGGSSGGSPPPALPPKRRRSGGSSGGSPPPALPPKRRRSGGSSGGSSASLARGGPNAVGLLTTNESFEKNINEVYNRTRAELDASSRDRSRSGLSR

SEQ ID NO: 192 - protein, 522 aa, Artificial sequence
  Synthetic C-intein::VirD2 fusion
MSNSTIKIATRKYLGKQNVYDIGVERDHNFALKNGFIASNCFNSGGSSGGSSGSETPGTSESATPESSGGSSGGSMPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRR

SEQ ID NO: 193 - protein, 1354 aa, Artificial sequence
  Synthetic Cas12a::N-intein fusion
MASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSSETPGTSESATPEGGSGGSGSCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 194 - protein, 629 aa, Artificial sequence
  Synthetic VirD2::N-intein::VirF fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGPLVRQAGTSRPSPPTATTRASTATDSLSATAHLQQRRGVLSKRPREDDDGEPSERKRERDERSKDGRGGNRRSGGSSGGSMSGSKKRRIKQDGSCLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPNSGGSSGGSSASLARGGPNAVGLLTTNESFEKNINEVYNRTRAELDASSRDRSRSGLSR

SEQ ID NO: 195 - protein, 1293 aa, Artificial sequence
  Synthetic C-intein::Cas12a fusion
MANSTIKIATRKYLGKQNVYDIGVERDHNFALKNGFIASNCFNGSSETPGTSESATPEGGSGGSGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 196 - protein, 1229 aa, Artificial sequence
  Synthetic Cas12a-no NLS sequence
MASKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 197 - protein, 1714 aa, Artificial sequence
  Synthetic VirD2::Cas12a fusion
MPDRAQVIIRIVPGGGTKTLQQIINQLEYLSRKGRLELQRSARHLDIPLPPDQIHELARSWVQETGTYDESQPDEERQQELTTHIIVSFPAGTSQVAAYAASREWAAEMFGSGAGGGRYNYLTAFHIDRDHPHLHVVVNRRELLGHGWLKISRRHPQLNYDALRIKMAEISLRHGIALDASRRAERGITERPITYAQYRRLEREQARQIRFEDADLEQSSPQGDHPEFSQPFDTSPFEASAGGPEDMPRPNNRQNESQVHLQEPAGVSNEAGVLVRVALETERLAQPFVSETILADDIGSGSSRVAEGRVESANRTPDIPRAATEAATHTTHDRQRRAKRPHDDDGGPSGAKRVTLEGIAVGPQANAGEQDGSSGGSSGGSMSGSKKRRIKQDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQDSGSGGSSGGSSGPLVRQAGTSRPSPPTATTRASTATDSLSATAHLQQRRGVLSKRPREDDDGEPSERKRERDERSKDGRGGNRR

SEQ ID NO: 198 - DNA, 1100 bp, Artificial sequence
  Synthetic a2 rt-pr
cttatttgttgattctgtggccatagattaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagt

SEQ ID NO: 199 - DNA, 1139 bp, Artificial sequence
  Synthetic D3 RT-PCR
cttatttgttgattctgtggccatagattaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgca

SEQ ID NO: 200 - DNA, 1131 bp, Artificial sequence
  Synthetic F3 RT-PCR
  misc_feature (5)..(5): n is a, c, g, or t
  misc_feature (12)..(13): n is a, c, g, or t
  misc_feature (44)..(44): n is a, c, g, or t
  misc_feature (633)..(633): n is a, c, g, or t
  misc_feature (636)..(636): n is a, c, g, or t
  misc_feature (830)..(830): n is a, c, g, or t
  misc_feature (982)..(983): n is a, c, g, or t
  misc_feature (1018)..(1018): n is a, c, g, or t
  misc_feature (1066)..(1067): n is a, c, g, or t
  misc_feature (1082)..(1082): n is a, c, g, or t
  misc_feature (1105)..(1106): n is a, c, g, or t
  misc_feature (1115)..(1116): n is a, c, g, or t
  misc_feature (1123)..(1123): n is a, c, g, or t
cgtangttgttnnttctgtggccatagattaggattttttttcncgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacnccntcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaanactattaccctcgaggtggagagctccgacaccattgacaatgtgaaggcgaagatccaggacaaggaaggaatcccaccggaccggcagaggcttatttttgctggcaaacagctagaggatggaaggaccctcgctgactacaacatccnnaaggagtcaactctgcacttggtgttgcgtcttcntggggggttttcaaatgctgctgatgaagtggcaactcaattactganntttgacctcttgaancttgccggtgatgttgagtctanncctggaccnntggcgcnagttagca

SEQ ID NO: 201 - DNA, 29 bp, Artificial sequence
  Synthetic PM10281
cttggacaagaagaagatcgcttggcctc

SEQ ID NO: 202 - DNA, 32 bp, Artificial sequence
  Synthetic PM10282
cgccaacacaacaatttaactctgggaggaac

SEQ ID NO: 203 - DNA, 1107 bp, Artificial sequence
  Synthetic A2 Left flank
  misc_feature (655)..(655): n is a, c, g, or t
cttatttgttgattctgtggccatagattaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctangatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaacc

SEQ ID NO: 204 - DNA, 1253 bp, Artificial sequence
  Synthetic A2 Right flank
  misc_feature (965)..(965): n is a, c, g, or t
  misc_feature (980)..(980): n is a, c, g, or t
ctacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggnccccaaattaatcanaatcggatccgtttaacagataaaaacaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatttgta

SEQ ID NO: 205 - DNA, 653 bp, Artificial sequence
  Synthetic A7 Right flank
  misc_feature (646)..(646): n is a, c, g, or t
aaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatttgtatttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatttngtaatta

SEQ ID NO: 206 - DNA, 687 bp, Artificial sequence
  Synthetic B2 Left flank
  misc_feature (430)..(430): n is a, c, g, or t
tttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatttngtaattaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgc

SEQ ID NO: 207 - DNA, 1260 bp, Artificial sequence
  Synthetic B2 Right flank
  misc_feature (1251)..(1251): n is a, c, g, or t
tacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatttngtaattata

SEQ ID NO: 208 - DNA, 1255 bp, Artificial sequence
  Synthetic B4 Right flank
  misc_feature (1251)..(1251): n is a, c, g, or t
tacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatttngtaa

SEQ ID NO: 209 - DNA, 835 bp, Artificial sequence
  Synthetic C2 Left flank
ttgattctgtggccatagattaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggagtcaacccttcaccttgtccttcgtctccgtggtggcatgcagatcttcgtcaagactctcactggcaaaaccataaccctagaggtcgaaagctctgacaccattgacaacgtcaaggccaagatccaggacaaggagggaatccccccagaccagcaacgtctcatcttcgccggaaagcaacttgaggacgggcgcaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcga

SEQ ID NO: 210 - DNA, 1250 bp, Artificial sequence
  Synthetic C2 Right flank
  misc_feature (82)..(82): n is a, c, g, or t
  misc_feature (694)..(694): n is a, c, g, or t
tacgtgaaaggcgagatcaccaaggtagtcggcaaataagctggagctgatgtctgtgtgatgtctgatgttggattttccnagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtantccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaattt

SEQ ID NO: 211 - DNA, 1264 bp, Artificial sequence
  Synthetic E6 Right flank
  misc_feature (6)..(6): n is a, c, g, or t
  misc_feature (15)..(15): n is a, c, g, or t
ttgganatttgtccntacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatt

SEQ ID NO: 212 - DNA, 1254 bp, Artificial sequence
  Synthetic G7 Right flank
tacgtgaaaggcgagatcaccaaggtagtcggcaaataagctggagctgatgtctgtgtgatgtctgatgttggattttcccagacattttaagaagaaatgtgatgtgtaatgggtctgtaatgacctttgaaaataagtttggtttgtgttgaactctattgtcccattaatgttactactgtttgttatcaatttgtggagctgatatataattatcaactgtatgctggcatattgtgtttgaattttgttctcaatccagtgaattggcgtatattagtgggttttttattcttcatgcttatcacggaggaaaagcagggatgagttgtgtgaaggatggtgatcatcccacgaattattagattttggtattataggttaaagatatttattaggtagggagaactcttggattagattctaaagtgatattttgaaaacacaccaaaggatttttgaacaaacggagatcatgatccctagtttcaattagctgccccttaccaagaggtagcaacttaaaaattatgctcgtgaagcatatttggtatcgtatataaattatgtaagcaatctgcttcagttggaacattaattggcttgcggaatgcacatttagatgatccacacaggtccacataaaaattcctaatcaattttagttatgcaatctttctgcttcaggtagtccttgtcttacagaaagcacattgagatgatccccacacagatccacataaaaaattcctaatcaataataacttgaaaatcattaaaagatgtaatgccatactaatccctaatttttgtgcaagtttttgtatactggaccccaaaaaataccaaaaagaaaaaacaagttattcagtgatatttttctgctccaatataaatttgattaccaaataccaaaaaataaaaacactattcagtggtatttttctgctccaatactggaccccaaattaatcagaatcggatccgtttaacagataaaaacaaaagcgatcgggttaaaatcccatttttacaaataacaacgcaggtttatacatgaaacaaatgtcattaccaagtgatatttttctgctccgatataaatttgattacaacgaaaaaaagtggtctactcacatgtttctccattttacttgtgtataaaactcatttcaagttgtatctgattcgtcgaaaaaacaaaacagaatagtaatactctataccctttttatcatcattaatttgtaa

SEQ ID NO: 213 - DNA, 1255 bp, Artificial sequence; identical to SEQ ID NO: 208
  Synthetic G8 Right flank
  misc_feature (1251)..(1251): n is a, c, g, or t

SEQ ID NO: 214 - DNA, 912 bp, Artificial sequence
  Synthetic G7RT-PCR
ccttatttgttgattctgtggccatagattaggattttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgttgagtctaaccctggaccaatggcgcaagttagcagaatctgca

SEQ ID NO: 215 - DNA, 889 bp, Artificial sequence
  Synthetic B3 Left Flank
  misc_feature (211)..(212): n is a, c, g, or t
  misc_feature (214)..(214): n is a, c, g, or t
ctttagcaactaccttatttgttgattctgtggccatagattaggatttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaanntncaggacaaggaaggaattcccccggatcagcaacgtctcatcttcgccggaaagcagctcgaggacggccgtaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgtgagtctaacc

SEQ ID NO: 216 - DNA, 890 bp, Artificial sequence
  Synthetic B6 Left Flank
ctttagcaactaccttatttgttgattctgtggccatagattaggatttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggcccaagatccaggacaaggaaggaattcccccggatcagcaacgtctcatcttcgccggaaagcagctcgaggacggccgtaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgtgagtctaacc

SEQ ID NO: 217 - DNA, 897 bp, Artificial sequence
  Synthetic E9 Left Flank
  misc_feature (887)..(887): n is a, c, g, or t
  misc_feature (891)..(891): n is a, c, g, or t
ctttagcaactaccttatttgttgattctgtggccatagattaggatttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaaagatccaggacaaggaaggaattcccccggatcagcaacgtctcatcttcgccggaaagcagctcgaggacggccgtaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgtgagtctnaccngaccaa

SEQ ID NO: 218 - DNA, 892 bp, Artificial sequence
  Synthetic F9 Left flank
  misc_feature (3)..(3): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (891)..(891): n is a, c, g, or t
ctntagcaactncntnatttgttgattctgtggccatagattaggatttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaagatccaggacaaggaaggaattcccccggatcagcaacgtctcatcttcgccggaaagcagctcgaggacggccgtaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgtgagtctaacccng

SEQ ID NO: 219 - DNA, 889 bp, Artificial sequence
  Synthetic G2 Left flank
  misc_feature (211)..(214): n is a, c, g, or t
ctttagcaactaccttatttgttgattctgtggccatagattaggatttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaannnncaggacaaggaaggaattcccccggatcagcaacgtctcatcttcgccggaaagcagctcgaggacggccgtaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgatgtgagtctaacc

SEQ ID NO: 220 - DNA, 890 bp, Artificial sequence
  Synthetic G7 Left flank
  misc_feature (211)..(213): n is a, c, g, or t
  misc_feature (877)..(879): n is a, c, g, or t
ctttagcaactaccttatttgttgattctgtggccatagattaggatttttttcacgaaattgcttcttgaaattacgtgatggattttgattctgatttatcttgtgattgttgactctacagatgcagatcttcgtcaagaccctcaccggaaagaccatcacccttgaggtggaaagctctgacaccatcgacaacgtcaaggccaannnccaggacaaggaaggaattcccccggatcagcaacgtctcatcttcgccggaaagcagctcgaggacggccgtaccctcgccgactacaacatccagaaggaatcaacccttcacctcgtcctccgtctccgtggtggcatgcagatcttcgttaagaccctcaccggcaagactataaccctagaagtcgagagctccgacaccatcgacaacgtcaaggctaagatccaggacaaggagggtatccccccagaccagcagaggctgatcttcgccggcaagcagctcgaggacggacgtacccttgctgactacaacatccagaaggagtcaactctccacttggtgttgcgtcttcgtggtggtatgcagatcttcgtcaagacccttacgggtaagactattaccctcgaggtggagagctccgacaccattgacaatgtgaaggcgaagatccaggacaaggaaggaatcccaccggaccagcagaggcttatttttgctggcaaacagctagaggatggaaggaccctcgctgactacaacatccagaaggagtcaactctgcacttggtgttgcgtcttcgtggggggttttcaaatgctgctgatgaagtggcaactcaattactgaattttgacctcttgaagcttgccggtgannngagtctaaccc

SEQ ID NO: 221 - DNA, 4101 bp, Artificial sequence
  Synthetic Cas9
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 222 - DNA, 4101 bp, Artificial sequence
  Synthetic eCas9
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctggccgacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctgccctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaaggcccctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 223 - DNA, 4101 bp, Artificial sequence
  Synthetic nCas9(D10A)
gacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

SEQ ID NO: 224 - DNA, 4101 bp, Artificial sequence
  Synthetic nCas9(H840A)
gacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgac

That which is claimed is:

1. A method of modifying a target nucleic acid, the method comprising contacting the target nucleic acid with a nucleic acid binding polypeptide, a T-DNA sequence comprising a DNA homology repair template that comprises an edit for incorporation into the target nucleic acid, and an *Agrobacterium* effector protein,
   wherein the *Agrobacterium* effector protein is capable of interacting with the T-DNA sequence, and
   wherein the target nucleic acid is present in a plant cell or a fungal cell.

2. The method of claim 1, wherein the *Agrobacterium* effector protein is fused to the nucleic acid binding polypeptide.

3. The method of claim 1, wherein the nucleic acid binding polypeptide is a sequence-specific DNA binding protein.

4. The method of claim 1, wherein the method comprises recruiting the *Agrobacterium* effector protein to the nucleic acid binding polypeptide.

5. The method of claim 4, wherein the *Agrobacterium* effector protein is fused to a domain capable of interacting with the nucleic acid binding polypeptide.

6. The method of claim 1, wherein the *Agrobacterium* effector protein is an *Agrobacterium* virulence polypeptide.

7. The method of claim 6, wherein the nucleic acid binding polypeptide is a Cas9 effector protein or a Cas12 effector protein.

8. The method of claim 1, wherein the method further comprises contacting the target nucleic acid with a CRISPR guide nucleic acid.

9. The method of claim 8, wherein the CRISPR guide nucleic acid is linked to an RNA recruiting motif.

10. The method of claim 1, wherein the nucleic acid binding polypeptide is fused to a peptide tag or to an affinity polypeptide.

11. The method of claim 5, wherein the domain capable of interacting with the nucleic acid binding polypeptide is a peptide tag or an affinity polypeptide.

12. The method of claim 1, wherein the nucleic acid binding polypeptide is a CRISPR-Cas effector protein.

13. The method of claim 1, wherein the method comprises recruiting the *Agrobacterium* effector protein to the nucleic acid binding polypeptide and wherein the *Agrobacterium* effector protein is fused to a peptide tag and the nucleic acid binding polypeptide is a CRISPR-Cas effector protein that is fused to an affinity polypeptide that is capable of binding the peptide tag.

14. The method of claim 1, wherein the method comprises recruiting the *Agrobacterium* effector protein to the nucleic acid binding polypeptide and wherein the nucleic acid binding polypeptide is a CRISPR-Cas effector protein that is fused to a peptide tag and the *Agrobacterium* effector protein is fused to an affinity polypeptide that is capable of binding the peptide tag.

15. The method of claim 8, wherein the CRISPR guide nucleic acid is linked to an RNA recruiting motif and the *Agrobacterium* effector protein is fused to an affinity polypeptide that is capable of binding the RNA recruiting motif.

16. The method of claim 1, wherein the T-DNA sequence further comprises a 3' homology region having homology to the target nucleic acid.

17. The method of claim 16, wherein the 3' homology arm of the T-DNA sequence has a length of about 5 nucleotides to about 1000 nucleotides.

18. The method of claim 16, wherein the edit for incorporation into the target nucleic acid is located in the 5' direction relative to the 3' homology region.

19. The method of claim 1, wherein the T-DNA sequence further comprises a 3' microhomologous sequence and a 5' microhomologous sequence.

20. The method of 19, wherein the edit for incorporation into the target nucleic acid is located in the 5' direction relative to the 3' microhomologous sequence and in the 3' direction relative to the 5' microhomologous sequence.

21. The method of claim 10, wherein the nucleic acid binding polypeptide is fused to the peptide tag and the peptide tag comprises a GCN4 peptide tag, a c-Myc affinity tag, an HA affinity tag, a His affinity tag, an S affinity tag, a methionine-His affinity tag, an RGD-His affinity tag, a FLAG octapeptide, a strep tag, a strep tag II, a V5 tag, and/or a VSV-G epitope.

22. The method of claim 10, wherein the nucleic acid binding polypeptide is fused to the peptide tag and the peptide tag comprises a GCN4 peptide tag.

23. The method of claim 10, wherein the nucleic acid binding polypeptide is fused to the affinity polypeptide and the affinity polypeptide is an antibody.

24. The method of claim 15, wherein the RNA recruiting motif and the affinity polypeptide are a telomerase Ku binding motif and an affinity polypeptide of Ku; a telomerase Sm7 binding motif and an affinity polypeptide of Sm7; an MS2 phage operator stem-loop and an affinity polypeptide MS2 Coat Protein (MCP), a PP7 phage operator stem-loop and an affinity polypeptide PP7 Coat Protein (PCP); an SfMu phage Com stem-loop and an affinity polypeptide Com RNA binding protein; a PUF binding site (PBS) and an affinity polypeptide *Pumilio*/fem-3 mRNA binding factor (PUF); or a synthetic RNA-aptamer and a corresponding aptamer ligand to the synthetic RNA-aptamer.

25. The method of claim 15, wherein the RNA recruiting motif and the affinity polypeptide are an MS2 phage operator stem-loop and an affinity polypeptide MS2 Coat Protein (MCP), or a PUF binding site (PBS) and an affinity polypeptide *Pumilio*/fem-3 mRNA binding factor (PUF).

26. The method of claim 1, further comprising modifying the target nucleic acid using the DNA homology repair template to introduce the edit into the target nucleic acid.

* * * * *

UNITED STATES PATENT AND TRADEMARK OFFICE
CERTIFICATE OF CORRECTION

PATENT NO. : 11,976,278 B2
APPLICATION NO. : 17/113068
DATED : May 7, 2024
INVENTOR(S) : Hummel et al.

It is certified that error appears in the above-identified patent and that said Letters Patent is hereby corrected as shown below:

In the Specification

Column 7, Lines 46-47: Please correct "−10%, −5%, −1%, −0.5%, or even −0.1%" to read --± 10%, ± 5%, ± 1 %, ± 0.5%, or even± 0.1 %--

Column 7, Line 50: Please correct "−10%, −5%, −1%, −0.5%, or even −0.1%" to read --± 10%, ± 5%, ± 1%, ± 0.5%, or even± 0.1%--

Column 12, Line 28: Please correct "0.2 · SSC" to read --0.2x SSC--

Column 12, Line 33: Please correct "1 · SSC" to read --1x SSC--

Column 12, Line 35: Please correct "4-6 · SSC" to read --4-6x SSC--

Column 12, Line 43: Please correct "2 ·" to read --2x--

Column 16, Line 18: Please correct "0-conglycinin," to read --β-conglycinin,--

Column 16, Line 47: Please correct "$PLA_2$-d" to read --$PLA_2$-δ--

Column 17, Line 20: Please correct "a-tubulin" to read --A-tubulin--

Column 24, Line 24: Please correct "Cash," to read --Cas6,--

Column 26, Line 44: Please correct "Cash," to read --Cas6,--

Column 30, Line 27: Please correct "(Vob et al." to read --(Voβ et al.--

Column 30, Line 29: Please correct "Cehm" to read --Chem--

Signed and Sealed this
Eighth Day of April, 2025

Coke Morgan Stewart
*Acting Director of the United States Patent and Trademark Office*

CERTIFICATE OF CORRECTION (continued)
U.S. Pat. No. 11,976,278 B2

Column 37, Line 21: Please correct "MO," to read --*etli*),--

Column 39, Line 48: Please correct "e)," to read --*etli*),--

Column 42, Line 7: Please correct "eth)," to read --*etli*),--

Column 44, Line 53: Please correct "eth)," to read --*etli*),--

Column 44, Line 56: Please correct "*Ochrobactum*" to read --*Ochrobactrum*--

Column 67, Line 67: Please correct "$OD_{600\ nm}$," to read --$OD_{600\ nm}$--

Column 69, Line 59: Please correct "AB53DVirD2" to read --AB53ΔVirD2--

Column 69, Line 65: Please correct "2 ·" to read --2X--

Column 70, Lines 2-3: Please correct "*tumefaciens* DVirD2" to read --*tumefaciens*ΔVirD2--

Column 71, Line 28: Please correct "2 ·" to read --2X--

Column 71, Line 53: Please correct "5 ·" to read --5X--

Column 71, Line 62: Please correct "AB53DVirD2" to read --AB53ΔVirD2--

Column 72, Line 42: Please correct "AB53DVirD2" to read --AB53ΔVirD2--

Column 72, Line 48: Please correct "2 ·" to read --2X--

Column 72, Lines 52-53: Please correct "tumefaciens DVirD2" to read --tumefaciensΔVirD2--

Column 73, Line 41: Please correct "a1" to read --α1--

Column 75, Line 27: Please correct "4 · SH3" to read --4xSH3--

Column 75, Line 38: Please correct "EF1a" to read --EF1α--

Column 75, Line 54: Please correct "EF1a" to read --EF1α--

Column 75, Line 58: Please correct "2 · and 3 ·," to read --2x and 3x,--

Column 77, Line 53: Please correct "EF1a" to read --EF1α--

Column 78, Line 6: Please correct "2 ·" to read --2x--

CERTIFICATE OF CORRECTION (continued)
U.S. Pat. No. 11,976,278 B2

In the Claims

Column 82, Line 4, Claim 20: Please correct "155" to read --claim 19--